United States Patent 9,932,598 (METABOLIC ENGINEERING OF MICROBIAL ORGANISMS) - sequence listing, part 2

SEQ ID NO: 1 - DNA, 4639675 bp, E. coli (residues 1,546,560-3,093,118 of 4,639,675)
tctgcggtacgccaaaagccgacttcctgaaagtgtgtgaagtgctggcctccaccagcgcaccggatcgcacaaccaccttcctgtacgcgctgggctggacgcagcacactgtgggtgcgcagaacatccgtactatggcgatgatccagttgctgctcggtaacatgggtatggccggtggcggcgtgaacgcattgcgtggtcactccaacattcagggcttgactgacttaggcctgctctctaccagcctgccaggttatctgacgctgccgtcagaaaaacaggttgatttgcagtcgtatctggaagcgaacacgccgaaagcgacgctggctgatcaggtgaactactggagcaactatccgaagttcttcgttagcctgatgaaatctttctatggcgatgccgcgcagaaagagaacaactggggctatgactggctgccgaagtgggaccagacctacgacgtcatcaagtatttcaacatgatggatgaaggcaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggtgagtcgaacgatgtcgatccggcgtctattcagactgaagtattccgtctgccttcgacctgctttgctgaagaagatggttctatcgctaactccggtcgctggttgcagtggcactggaaaggtcaggacgcgccgggcgaagcgcgtaacgacggtgaaattctggcgggtatctaccatcatctgcgcgagctgtaccagtccgaaggtggtaaaggcgtagaaccgctgatgaagatgagctggaactacaagcagccgcacgaaccgcaatctgacgaagtggctaaagagaacaacggctacgcgctggaagatctctatgacgctaatggcgtgcttattgcgaagaaaggtcagttgctgagtagctttgcgcatctgcgtgatgacggtacaaccgcatcttcttgctggatctacaccggtagctggacagagcagggcaaccagatggctaaccgcgataactccgacccgtccggtctggggaatacgctgggatgggcctgggcgtggccgctcaaccgtcgcgtgctgtacaaccgtgcttcggcggatatcaacggtaaaccgtgggatccgaaacggatgctgatccagtggaacggcagcaagtggacgggtaacgatattcctgacttcggcaatgccgcaccgggtacgccaaccgggccgtttatcatgcagccggaagggatgggacgcctgtttgccatcaacaaaatggcggaaggtccgttcccggaacactacgagccgattgaaacgccgctgggcactaacccgctgcatccgaacgtggtgtctaacccggttgttcgtctgtatgaacaagacgcgctgcggatgggtaaaaaagagcagttcccgtatgtgggtacgacctatcgtctgaccgagcacttccacacctggaccaagcacgcattgctcaacgcaattgctcagccggaacagtttgtggaaatcagcgaaacgctggcggcggcgaaaggcattaataatggcgatcgtgtcactgtctccagcaagcgtggctttatccgcgcggtggctgtggtaacgcgtcgtctgaaaccgctgaatgtaaatggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaagggggcgaacagatggctatggaaacgcaggacattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatcccggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgccgggttgattttccactacatcggtattggcccgaataaggaagtggacgatgacgaggaggatcatcatgagtaagtcgaaaatgattgtgcgcaccaaatttattgatcgcgcctgtcactggaccgtggtgatttgcttcttcctggtggcgctgtccgggatttcgttcttcttcccgacgctgcaatggctgacgcaaaccttcggtacgccgcagatgggacgcattttgcacccgttcttcggcattgcgattttcgtcgcactgatgtttatgtttgtgcgttttgtgcatcacaacatcccggataagaaagatattccgtggctgttgaacattgtcgaagtattgaaaggcaatgagcataaagtggcggatgtcggtaagtacaacgccgggcaaaagatgatgttctggtcgatcatgagcatgattttcgtgctgctggtgaccggggtgattatctggcgtccgtactttgcgcagtacttcccgatgcaggttgttcgctacagcctgctgatccacgcggctgcgggtatcatcctgatccacgccatcctgatccatatgtatatggcattttgggtgaaaggatcgattaaagggatgatcgaagggaaggtaagtcgtcgctgggcgaagaaacaccatccgcgctggtatcgtgaaatcgagaaggcagaagcgaaaaaagagagtgaagaagggatataatctcttttgaactttaagctgaaaatggcgctgtaaaaggcgccattttcatattgtagacaacgtaggctttgttcatgccggatgcggcgtgaacgccttatccggcatgaaaacccttcaaatccaatagattgcagtgaacgtgtaggcctgataagcgtagcgcatcaggcaatgttgcgtttgtcatcagtttcaaatggcgctgtaaaaggcgtcattttcatattgtagacaacgtaggctttgttcatgccggatgcggcgtgaacgccttatccggcatgaaaacccttcaaatccaatagattgcagtgaacgtgtaggcctgataagcgtagcgcatcaggcaatgttgcgtttgtcatcagttctaaatggcgctttataaagtgccatttttttattgcgtaaccagacggcgtaatcgcgacacatccactgttttttctgcctctgccagactccaggcgttttgcagattcagccacatttgcggcgaactgccgatcaccacggaaagtttaatcgccatttctggcgtcaaagctgcttttcctgtcagcaatcggcttgccgttgagggagcaatttccattgctctggcaaactcgcgcaggctgacattaagttcgtccagtgattcctgaataatgtcccccgggcggggatgattggccattttcattagtgtctttactctcagtagcgttccttcactgggaacactatcattattgttccttcctacgcaacaataatccatttagccatttcatgttggagagtgtgcgatgctgcgacccgaacatggcagtcgcagcaaaggcctcttagtgacggaaatcaatcaccatgcggccacggattttgccttcttccatctcagtaaagatggtgttgatgtccgctaacggacgcagggcgactttcggcaccactttaccttcggcggcaaactggaaggcttcagttaaatcctggcgcgtgccgaccagcgaaccgaccacttcaataccatccagcacaagacgtgggatatccaggctcatagactccggcggtagaccgacagccacaacacgaccgcctgcacggacagcatcaactgccgagttaaacgcagctttagctaccgctgttaccaccgcagcgtgagcgccaccagttttctcctgcacaattttggcggcgtcttcggtgtgtgagttaatcgctaaatctgcgcccatttcggttgccagttttaactgctcatcattgacatcaatggcgatcactttggcgttaaagacattcttcgcgtattgcagggcgaggttacccagaccgccaagaccgtagatagcaatccactgccctggacgaatttttgacagcttaacggctttgtaggtggtgactcccgcacaggtaatgctgctggccgccgccgagtccagaccatctggcacttttaccgcgtaatcggcgaccacgatgcactcttccgccatcccgccatcaacgctgtatccggcatttttaactgaacggcagagcgtttcgttaccactgttacagtattcgcaatgaccgcatccttcgtagaaccacgccacgctggcacgatcgcctggttttaatgaggtgacacctggacccacttctgccaccacaccgatgccttcatggcccagaattacgccggttttgtcaccaaaatcgccattcttaacatgaagatcggtatgacatacaccacaacactccattttcagcagggcttcgccatgtttcagtgagcgcagtgttttatacgtaacgtcaacatgatgatccttcgtaacaactgcagccttcatagttcctccttttcggatgatgttctgcatagcaggtgaggcaaatgagatttattcgccactacccagtatggatgagatctgaaaaagggagagggaaatagcccggtagccttcactaccgggcgcaggcttagatggaggtacggcggtagtcgcggtattcggcttgccagaaattatcgtcaatggcctgttgcagggcttcggcagaggttttcaccgccacgccttgctgctgcgccattttgccaaccgcaaacgcaattgcgcgggagactttctgaatatctttcagttccggcagtaccataccttcgccgttcagcaccaatggtgaatactgcgccagcgtttcacttgccgacatcagcatctcatcggtgatacgtgacgcgccggaagcaataacacccaggccgatgcccgggaaaataaaggcgttgttacactgggcgatagggtagattttatctttccataccactggattaaacgggctgcccgtggcgaccagcgcgttaccttcggtccaggcgataatgtcctgcggtgtggcttccacgcgtgacgtcgggttagacagcggcatcacgatcggacgcggacagtgtttatgcatctcacggatgatctcttccgtaaacagcccggtctgtcctgagacgccaatcagaatatctggttttacattgcgcaccacatccagcagtgacagcacatcgctgtcggtatcccagtcactgaggttttcgcgcttctgcaccagtttggtctggaaaggcagcaggttcggcatcttgtcagtcagcaagccaaagcgatcgaccataaagactttctgccgcgccgcttcctcgcttaatccttcgcgctgggtctgggagatgatcatttcggcaatgccgcatcccgctgaacctgcgccaaggaagacgatttttttctcgcttaactgaccacctgccgcgcggcttgctgcgatcagtgtgccgactgttaccgccgcagtgccctgaatgtcatcgttaaaagaacaaatttcattgcgatagcggttaagtaacggcatcgcatttttttgagcaaagtcttcaaactgcaacagcacgtctggccagcgttgtttcacagcctggataaattcatcaacgaattcatagtattcgtcgtcagtgatacgcggattacgccagcccatatacagcggatcgttaagcagctgttggttgttcgttccgacatccagcaccaccggaagggtatacgccgggctgatgccgccacaggcggtatagagcgacagtttaccgatcggaatgcccatcccgccgatgccctggtcaccaagccccagaatgcgttcaccgtcagtcaccacaatcactttaatattatggttcggcacgttttgcagaatatcgtccatattgtgccggttctggtaagagataaacacgccgcgtgaacggcggtagatctcagaaaaacgctcacaggctgcgccgacggttggggtataaataacaggcatcatctcatcaagatgattgtttaccagacggtagaagagggtttcgttagtgtcctggatgttacgcaggtagatgtgtttgtcgatttcggttttgaatccctgatactggatccatgctcgttccgcttgttcttcgatggtttcgaccacttccggcagtaaccccagcaggttgaagttacggcgttcttccatgctgaaggcactgcctttattcaacaacggaaattccagcagtacagggccagcgtaagggatataaagcgaacgctgtttttttgtttttggttccatgtcactcactcttttttgaatatccatccctggggggcttttatcgtctttgctttaccgccagggcgtcggcctcaagtataaagcagataaaaacaaaaacaccattgcgcaggcaatggtgtttaatcgtcattgaggactgatggttatgaattacttttcagcggggcgttttctgccggttgggttatttactacgctggatttgtcaccttcggtaactattttgcgctggttagaaattttatggtccagtccaagaatatgacgtgcctgacggttcgatttcattttaactcctcaatcctgtagctagttttaaggacaacatcgccgtagcgaagaaacacgtgctaaacccctaaattaggttgccgatcaagcatagcaccttaaagcgtagggtgctggccactgaccacataattgatcgtttgctggtagatatcactgaggatgtcgttatcagaagcttcaacccatttggtcagctccatgagaatgtcatcttcagtgacaacaccatgctgtgcccgaaggccttgctcaatggcattaaccagagcgggttctgctgttgaattttctgcctgataataagtaaacatagtgattctccgtgtctgtgtatttatggtgtctgctacggatcgcagatttataaagcacattcagcatggcaaatatttgccgcttcgttgttaagattagtcctggttgatgatttttatattttaacaccatgatattcatagggattgtgattggtatgatccgattaatattgatacaatatcttttgggttatatattcccggtaatctattgtgggaatttaatttaagtgcagaagtaatattttcgccggattttattcggaatatcctgcttatcctcgtgctgtttctcacgtagtctataatttcctttttaagcccacaggagagcaacaatgacaatccataagaaaggtcaggcacactgggaaggcgatatcaaacgcgggaagggaacagtatccaccgagagtggcgtgctgaaccaacagccgtatggatttaacacgcgttttgaaggcgaaaaaggaaccaaccctgaagaactgattggcgcagcgcatgccgcatgtttctcaatggcgctttcattaatgctgggggaagcgggattcacgccaacatcgattgataccaccgccgatgtgtcgctggataaagtggatgccggttttgcgattacgaaaatcgcactgaagagtgaagttgcggtgccgggtattgatgcctctacctttgacggcataatccagaaagcaaaagcaggatgcccggtctctcaggtactgaaagcggaaattacgctggattaccagttgaaatcgtaaagcattgccggatgacgcgtcaggcgcgtgaatgcctgatgcgttgttagcatctctacagcgcccgccagcaccggagctcacgtccgtcctcccttattgctaatgattgccggacttcacatccgtgggttgccagcgggcaacgttcgtagaaaaaacagccttgcggcaacgtgcggtttcccggcagatccgttttacgtaatgcccattcttcctccagcggtttatcaatggcggggagggaatccagcaataatcgggtgtatggatgtgcaggtgccgtcagcacctgctgcgcgtcgcccagttctacaatctgcccgagatacatcaccgccacccgatcgctcatatgacgtatcaccgagacattgtgtgaaatcagcacataggtcagcccgtgattttcctgtagcgttaccagtaaattgaggatctgcgcctgaacggagatatccagcgcagaggttggctcatcaagcacaatcacgtcaggctgcgaagagagtgctctggcaatggcgatacgttgccgctgcccgccggagaacgcatgaggcaggcggtcgagatactccggacgaatacccacctgcacagccaactcctctgccaacgctcgccgctgttgttcactactacgcttagctatccagagcggttctgtgatgatgcgccacaccggtaagcgcggattaagcgaagagagcgggtcctgaaacaccatctgcataatgcgttgtgagccagaacggatgtactgcccgtggctcggttgcagcatacccattaaaagctgtgcgagggtgcttttgccgcagcctgactcgccgacgatccctaaggtttcaccacggcggatctgtaaatcaataccattaatggcatgaacatgttccgtagttttaccaagccagtttttacgggccgggaaattgatatggacgtcgcgtaacgttaataacgtgtcagacacttataacctcctgctgcggataccaacaggcacagcgctggttgttgtcaccacacgctgtcagcgccgggacgttttcacactgtgcacctgccgcatagcaacgatcgcgaaaagcgcagccgtcaggcaaatgggtgaggtttggtaccgtccctggaatggcgggtaatagctggcgtggtactccatgttctggtgcgcattgcagcaaaccaatggtatacggatgccggggatgatggataacgtctgccgtcacgccgctttcaattacgcttccggcatacatcacgtaaacgctatcgcacagttgcgacaccacggccatatcatggctgatgaacagaaccgcagttccactggcgcgggctttatgtttaagcaaacgcagtacctgcaactgcaccgtgacgtccagcgccgtagtcggttcgtcggcaataatcaattgcggctcgcaggagaatgccagcgcaatcattacccgctggcgcataccacctgaaagctcaaacggatagcgcgacataacttccacggcatccgggatttgcatctcttccagcaggtcaatcgctttagctctggcttcccgacgacttattggttgatgatggcggatcacgtccatcatctgaagacctattcgacgtgtcggattgagggcggtcatcggttcctgaaagatcatcgccactcgtgcgccgcgccactgacgaagctgtttttcccgcgcgttaagaacatcttctcccagcagggaaatctgcccccgatgtacgcaataactgcccgtcggtagcagacgcataatcagcattgcggtgactgatttacctgagccggattctcccaccagaccgacaatttcaccgcggttaatctgcaaggacacattgttgagcgcgtgaacatcaccgttaaaaccggggaaactcaaatgcagttgttgaatgtccagaacgggttgggtcatgactgctttcctcctgctttcgggtcaagcagatcgcgaataccatcaccaaagagattaaacccgacggcggtaagcaaaatcgctgcccccggaaatgcgcaataccaccactgatcgagtacatagttgcgaccatttgctaccatcgcgccccattcagcactcggttgttgagcacccaggccaataaatcccaacgtggcggccattaaaatcgcgctaccgatatccagcgatgcctgcacgatcagcggcggtagggagttacgtaaaatatgccagttgatcagatgccaacgagacgcgccaaaggttttcgccgcctgaacataggtatactggcgtacaactaatgcttgcccccgcgccaggcgcacataaaagggaattcgcacaatagcaatagccagcatggcgttaaacaaactcggcccgagagcggcagccagtgccattgtcagtaccaacgaaggaatcgacagcataatgtccatgatgcgcatgatgatggcgtctgcgcgtccaccaagcacaccggatagacatccgagtagcgaaccaatcatacccgcaatggcaaccacgactaatccggcgagaattgattgctgactgccgaccagtacgcggctaaacagatcgcgtcccacttcatcggtgccaaaccagtgcgccgcagaaggcggcaaaaggcgggcggttaaatcaatggcgttgggatcatgcgtcgccagccacggtgaaaaaatcatcatcaatagcattaatacaatgatgactgcgctggtcacggtgagcggactgcctttcagcatccataccagttttgcaccgttaaatcgcgtttgtttttgtgggcgtacggcggacgtttcctcgcttagcatcattcaccacctccacgtccgatacgcggatcaatccacaaatagagcaaatccaccaccaggttgaccagcacataagcaaatgaaaccacgacggcaaagcccatcactgccgggaagtcgagcgcctgtattgatgttactacccatgcacccattccgggccaggcaaaaacggtttcggtgagcactgcgccatacaacaaatcgcccagcgccaaacccaatacggtaatcgatgggatcaacgcattgggtagcgcataacataaaacgatataccagccgggcaagccgctggcccgggcggtacgaatgtagtcttcactcaattgttccagcatcgctgagcggatctggcgagcgacaattcccaggtgaacgaacgccagcgttaatgccggtaagatgagatgttgcaacgcattgaagaagacttcaccgttgccttcaagcagcgcatcgagcagataaaagccggtaacgtgcgttggtggatccagccagtcatcaagccttccgccgccgggaagaatttgcagatgaccataaaacagcacaatgacgcccagcccaagccagaacgcaggtgtggagattccggtaatggccattattcgcaccagatgatccagccagcgatttcgccagactgcagagagtatgcccagcgggatgccaatcaggagtgccagcagcagggcaccaaaagccagctccagcgtcgccgggaaaaatatacgcaactcttccagcaccggacgcccggtacgaatggatgttcccaggtcaccatgaaacaggtcgctgacgtagcggtaaaactgtacatacagtggctggtccagtcccagttgctggcgaatattttccacgatagcatcgctggcgcggtcacccgccagtaaccgcgccggatcaccagggatcagatgcgagataataaacgtaatcacgcagacgcccgccaccacgagcaccagcccccagcagcgttggcgtaaaatactccagaaggtcacgttatttactcatggtattgatattgaagacctgttccagcatgggattgaacacaaagcctttcacctctttgttcatcgccagttggtagtttttctggaacaggtacacataagcagcgtcatcaatgacgattttctgtgcctgctggtagtcccgggtacgctgcgtctggtcggtggtcgcaagcgcattgcgcagtaacttatcgacctcactgttttcatagaacgagcggttacccggcagaccttttttgtctgactcaaaccagtaattcataaacatatacgggtcggcaaaatccggactccagttgccaatcgcaatgtcgtaatcacctttacccactctgtcgcgcatggtggcgttcgccagcttttccagcttcacaatgatgcccagcttgttgagactggattgtgtcgccagagcaataggctcccagttcggatcgttatcggagtagagaaacgtcaggctggtgggtttgctcgtcactttatcccattcggctttggctttcgtttcgtcatggttgtattgcattgccgtcgcatcgtagccccacatgccttccggaatcgggccgcgcatctgttttccgttaccactcagaatgccgttaaccatgccctgataatcggtagaccaggaaatggcccgacgcagatccgcctgattaagaggcgctttgctgttattcagatacagataggtaacgcgcagtgacggatactctgccacattgactttattttcctgcttcagggcgttgagttgatccaccggcagcgcatcggcaatgtcaatgtcgccacgggagagctgcaggcgacgggaggcactttcaccaataatttttaccgatacccgtttgaagttcggtttattgcctgggtaatgcggatttggcaccagaactaattgctgacctttttgccagcttttcagcataaatggtccggaaccggcggtattttgcgcgaggaagccgcgagcatcatccgctgcatgttcctttaagaccgccggattgataatggatgcaccgtcattcgccagcgtgtagaggaacggtgcgaatggttggctaagggtaaacttcaccgtatgttcgtcgggagcatcaatctttaaatctttgggaaatgcttctgctggcccctggccgatttttagtagccgctcaaaagaaagttttactgcttcggcagtgacaggtgtgccatcggcaaatttagcattatctttcagggtgaacgtccactctttttgatcgtcagacgctttccagctacttgccagatcgccttcaacgtcggttgagcctttatcaccgtccgttttgtactgaaccagccgctgataagacgggtaggtcactgtccagtcgttattatctattgttaccgccgggtcgagggtttgtggatcggcggccttaccaatcaccagcatatcttttggtacggcggcgtgcgcaaccgggaaatttgtggcaaggacgagcgcgagcaatgtgggacgaaacgatatcgatctcttcatgacagtttcctgattaactgacgtgctgtgtgccaggggatataaaacaagagaattgatcagcgagcagagggtaactcgctgcctggggtaattcgaagtgccaccattcgctggagataccgacaaaaccgccaccagtcattatcgcattcagcaacagccgattgcgctgagcggcgggcgggacggaagggtgataggcatgggagcgctcgtgcatttcatcgaaccctgcgcccatatcgaggatgttcccgtgctcatcacgaagcgtcaggtcgatcgccgtgccacggctgtgattagaaccgaccgtcacatcaacaacatattgcgggtctgggcaggcttgccacaacatcgcctgtgcttgttgtgggcgatacgcatcgtaaatcaccagttgtaaccctgacagctgggcgatgctgatacttttcgccagcgcggtaatcgcatccttgtgtaacagacaacgcgcttgctgataaatagctttacctgtgatgttatcagcgcaggcgtatttcaattcgatctccagatcagggaagattacggctaaatcaaccagttcggtggtatccgacataaacggttcctgtataagacaaaaattgctgcgctttccgcttatgcagatctcatgccatgccgggataagcgccagaatgctggcttaaagttatattttttaacttttgatcaacatttgtgcagcgtagtgcagttttggtgcaagaggggaagttaaggaaggaatctcccggaatcgtagctgaaatcacagtatttaagtgacagtgtcacgttaaatgaaaacccgcgagtgcgggcgagaggaatttgtcagattttcagcggtaacacgctgctcatccagcctggaatttcttcggcgggtagggggcgggaaaagaaatatccctgaataacgcgacagtggatcttgcgtagcatctcaaattgctctttggtttcgacgccttccgccacgacggttaaattgaggctttgcccaatgctggtaatggcttcaagtaaggcaaggatgcgtttttcggtcagacaacgatcgacaaaacttttgtcaattttgatttccgttaccggaagactgactaagcgggataatccggaaaagcccgtaccaaaatcatctaccgataagcccacgcccatatcacgcaggatctgaatgcgcttaaagatttcggtatcgtgttccatcatcatgctttccgtgatttctaccgtcagctggtggccgtcaataccccaggcgtgcattgcatcagacacctgattaggcagttgattactgcgaaagtgcagcgccgacaagttcacggataacgccgggatatgaatattctggctacgccattctgctaactgacggcaagcttccgcgatgacccagcgcccaatattttcgatttcaccaatctcttctgcgagaggaataaaccgtgaagggggcacatgaccatgcaggggatcgtgccagcgagcaagggcttcgatgccgtacagttcacccgtttctgcgaagatttgcggctggtaaaccagtttcagttggttattgctaatcgcttctttcagcgctgcgcctaaaaccaaacgctcttttaccatttcgttcatcgccgggctgaagaactgccagccgttaccgccattcttgcgaatataatccattgcattgtgagcagtggagagcaagtaatcgcggtttttacccaggtcgtagctgatgccaatactcaaggtaagcgggaagggtttatcgtcaatcattatcggcttgctgaccacattccgtagctcatcggcgatttgggtaatgttactgacgtcgttttcgaggctcacgaggacaaactgcgtaccttcgatacgacagagatactgatccggtttgagtttttcacgaaagcgattgaccacttccagcaatgcctgatcggcccacgcatagccaaggctatcaatcacatcctgaatatggtcaacaccgatgagatacaccacgggagagacggctttgtcgaccaggtcatcgaggtaattgtgcaggttattgcgatttggcagaccggtcatcggatcaaattggatgagttgttcaatatgctgacggcttttttcctgttccagcgccagcgcggccatatgctggctgatatctgccacgcgttcgataaaggcgctggtttctgctcctgacgaggttttaatttgcaggatccccgcaggcgcgccatcacgctgacgaatggtcgctgaccagctttgcgcattttgaatttctgcaccgtgggaagatgacgcccagtgtatcggcatcccgttgcgcagtgcgaacagcgaaacatgcgattcgttgagtacagattcgatgttacgacaaatgatttcccccatttcatgaaatggcgggctgctgcacatggcggcgagaatattgccttcaagctggcgaatctgccgttcttcggtgatatccgagaaagtcattaccaggttctgcagatgcgcgagcacgtcataaaccgggctgatagaggctttaatccagattttttcaccggtgcgcgtcaacagcagaaattcgtcctgatcgcgggcggttttccatagcaactgttgtaaacgaatgcggttatcggcagggaattcaggaatgttcaggagtgtatcgggctgcataccgctggcttcgctaatgcagtaaccaaacatttcggtaaatgcgcgattgcactgcacaatatggcgttccggatcgaggacaatcaccggtcggtcgagatggtcaacggcaataatcaattgtcgggtctgttctttttgcgccatttctacgctggcatcccgtaccagcgccaggtaataaactttcccctcggcgctcactttcgatagcgcaaaacgggtccagattttactgccgtcttttttctccagctgcagctcccgactcatcccctcaacacgcgctttaccgccttcacggttgtgacgaatgtattcaggatgcgcaggacgcaaatcccgcggaatcagcatatcaatgttattgccaatgacttcttcacgtttgtatccccagagcttctctgcggcggggttgaaaaacatcacttcatcattttcgttaattaacaccgcacccatcatattttgctcaagggcggggaaaaaaatgccatcggcggcattatccgcatcggttagcttcatgattacctctgcatcctggcgcatctaaagactggctttccagagttcaacacggtttctacctcgtcttttggcgatatacagagcttcatcggctatttgaatgaggcgctcatagtcaggatgaccattaaacatggcggcaccgatggaaagtgagagggcaatatcttcgccgtttgcggctttcagtttggttttctccacccgactgcgaatacgttctgcggtacgtaacgtttcgttttcagaagcttcagtcaaaacaatgataaattcatcgcccccgtagcggaaaacataatcactactgcggacgttgtcataaaaggcctgagagactttacgcagaatttcatcaccagtgttatggccccacgtatcgttgatctctttgaatttatcaacgtcaataatcagcactgacagcggtgtaccggtccggttggcatgggcaatttcgcgtttgaagatagtcggtaggaaacggcggttaagtaatttcgtcagtacatccataccgacttcgtggcgcgatacttcttcaaacaattcacgcagcaaggtaataatttgcgatacggtatttcttatctgtaataaaaatttcacccgcagacttctgttattcaaatttctggtgttacgcatggtttgattgaaaataccgtcgaaatcctgaatcagacgggagatatggcctacttcggcaataccactaaaataatgtcgacctttatggttaaaccacaggccaaaatcagcctggcttaaaggcaaactactgcctaaatcagaatccagcaggattttatagataatatctatttcccatgaaagtattgaggctatttgccgttctttttcttcttcggcgttttccagtaacgagaagatacgatagttttcatcttcctttgaggcactactgtcactaaaggtaaacgcgcgagtcatcacttccatcgcgatatcaatactgttaatcgagaaatggtagacctgaagtttttctgcggcggaataatccgaagagaagatcaccggatagaggatttttttcagcacccgaaaccccatctcgacaatttctaccggaattcctatgcgggcatgcacttccgcgacggtatgctggatttgtattagcctttcgacatcgtcaacctgggcagaaagcacgttaataatccagcgttccatcgcactcttcaactgccgctcaacttgttcattactcaagaattcttcggcatgcgggtcgatgcggacaattcgataaaactcgatactcagataatgagcatgcgcaacggcaatttccgcggctttagcacgaatgggcggatctgcctgttcgacaagtccggtccactcatctttcattcttttaaaatacatctccataattcacacccttataaggctgggaaatcagacggaatcaaaatgaaacgcaacgtgcgagatcgactaactgcaccatattctcctgaaatatgaagatatactgaaaagaaataagcgatttaggacagtttcaatctacgctactgttcttcagaagagtatagcccatcgtaattatttttcggtgacagcgaatatcgtatggtttttcatattcatacatttttattagggatttatggctgtttaactaagtgtggttaatttgacttaagtaagcatgattattagtgggatagtttaagagggtaacaagccggtgggtaaagcaccggcttgttacaaagtaagaatgggagtttaactgccccagcgactttgcagatagctgaccgcttgttgagtctgcggtttattcagatagtcctcacggaacaagatggtgccgctaatttcgggcacagcatcgttaagatcgagctgctttttcagttccggtacgccgccgttaatcatccagtctggctctatctttgaaggttcacccactttatagaaggcgataccgatatacaggcgggtcctggtcggtttaacgacatccgcccaccattttgccaacacgtcataacgcgcggcactccgtgagaacggccagtaaatttggggagcaatgtaatccagcaatccttgttccacccatcgacgggtgtcagcgtaggattcgtcataggctgccgcgcctcgggtatcggaaccgagcggatcgtgtgatcggttacgccacacgcctgccgggctaacaccaaattcgactcccggcttaatgcttttaatggtgtgcgatacctttgcaattaactgctgagtattgttgcgccgccagtctgcttttgacgcaaatgcgcctccgtatttacggtacgtttcgttatcatttagccgtgaacccggtgactccgtatagaaatagtcgtcaaactgcacgccatctacgggatagcgggaaaccacttctgcgactattgatgtgatccagtcctgaacctcagggatgcccgggtcgaggacaaagcgatcgccagacgttctgatccagtcgcggtgttgcacatagacgctcgccggttgttgagacagagtgctattcagttccctgatagtaccgggcttcgtattaaccgatacgcgataggggttaaaccaggcgtgtactttcatcccacgcttgtgggcttcgtcgagcataaattgcagcggatcgtaacccggattttcaccaatcttaccggtcataagatcggaccacggcaaaattttcgatggccacagggcggtaccgtccggcttgacctggaaaaagaccgtgtttatgccgagacgttgcagatgatccagtttgtcgatcatcgcctgttgttgtacacgggcccggctggtggggttactaatgttaaccgaggaaaccggtggccagtcgagccgagaaaccgtggccagccagatgccacgcatcggttgtgacgattgttgcgtcgtggctggtggctttgaacctgctggtggtgtcaccatggactctggaggcgtgcttttacaactacacagtaaaagtgccagtgcaactagtatcgctggtcttctaatcgttaatttcttgtttcgggagcagatatccatatgtgctggtttccggtaaacagatgtgcgctcattctcgtacttatccccgttaagtcaatacgacagcaagcacgaaaaagggagcgatgaattatcgctcccttgtcttataaccattcagacatggttagtgtttcttgtcattcatcacaatatagtgtggtgaacgtgcacgcgggtgcaggaagaagtgaccttttggtgcgttctgactgttgattggctccagagtgacgccggtatttgctttgcctttacgatcatgaacagcatagagaataaagggcagggcaagtaccaccaggaaactaacaaccagtaattcaacatacatatcggtagaatcaccctggatgttatccggcggcaggaaggaaacaataaacgccataattgaagtcagcagaccgacaattgccacgaccagtttcacccctttaccaccagggatattaaatgtgcgttttaagtcaggatgtttaagaaccaacacaatgtagccaataaacagcatgaaataagcacacagataaatcaccaccgtcagcgccagtgcgatcaggaaggacatgttgttaccgccaccggtattggtgaggatgatcaacgcgatagacgtaatcaccagctgcgaaatgaccagcgttaccggtacgccatttttgttcattttagcgaatgccgctggcagcaggtttttctgcgctgttacatacatcccgcgagaaggaccaacaatccaggaggcgatttccgccagaacacccagcaacagcagtgcggagatcacgcgaaccgtccactcaatttctggtgccacatgggacatcagaacggtaaaggtttgcattacccctgcggagaggttgatttcattacccggaatgaccatcgcaatagacaaaccaccaacagagcttaagcagattgccgccaccatcagcagtaacatagccaacggatagtcgcgccctgggttgctcatttcattgacgtgggttgcggatgcttctacgcccatataactcaaaatgaaggcaacaaatactaccagggtgcccactttagagaagtcagggaagaaggtcttcgaatccatttcgatagcaacgggggcaccggagtgcagataaatagccgctaatgcgatcaaaataaatgcaggtaacaggataccggcgaagaagccaactttagcaattcgcgccgtgtatttcgtgccaccaaactgcgttaatgccagcgcccaaagaatgatgagtgctgcaatagttttggtaatggggtcttcattcagcgctggccatttcaggatgtaggagagtgcccctaacacgaaatagagcatcggaataaaaccaatggcgatttgcagatagccaaatgagatcgctgcaaatccccatctcggccccagagtatttgatacccaggcgaagacaccaccttcttcccagccgtcgacggtggccatttccgcagcacaaagtcccacgggaataaaccataaaatcccgcctaatagcaggaagaagactaatgaaaagcccgatgttgcgaaggtagggtattcataaacagccattaccatcgatgccgttatggcaaagaatccaagtaatgtgagctgcttagctttacctgtctgtactgatgtagccatattatccccctaaaacggtattcctgtcggaaccgcacctgttttgttctgaagcgtattcagaacaatattttccgttgctaatgccagtgaacagactttggaaattgtcccgaaacgggttcgtttcgggacaccgttaccgttaaacgttatcaggtatgtttaaagctgttctgttgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtatcggcctggaatttatccagcgcatcgtgcagcggttgtgggaactcatagttaccagtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttgttaatggataaatccatcaatttgtggacattttcgtcgtcccaggtctggcagaaagtggccaggttctgacgagcgttgccatcaagatataattcgtcattgataatctggaatgcgacatcgtcgcgcatttcgtgcagcggaaaacgttttgattctgcgatagtggaaatagacttcgcaccaaaacgtgaatcgagtagttccgaccttaaatccgttacttgcttcttatccattttaaactccttaaaatgattggatcgcattaaaaaagtaggatttatcgataaagtaagcaagtgcaaaggactcgtgtttaaataacaaaatcctaatgttatttatcgtgagatattacgcgaataatattttttcattgaaaaacaatacaatatgaaattcttgggtggtggtaaggtgttttatgctgttatttttatgcgcattctgtgtctcctgaattatcacgtaaaaatcagaccttaaaatatcactattagtacttgattattattttgaacgcatttataaaattattacataaaaatagcgaatattgctaaaatccccgccaacgatgtgttgacggggctgttattattttggcaataatactccggtataagtatttaccggatgagaaagatattgtttaacggcagtgttaacattctctaccgtcatttgtttcaacaattgctcctgctcagtccatgctgcaggatcgtcatattgaataagactatttacaatagtgttcgctaattgttgaacgctacgctgttggatatcgaggctgcgctgaacgttttgctggtattcattcagttcttgctcactgatccctttagccagacgcttaaccatcacttcattcgctaacgttaacagttcatcatgtcgttctggttgacaagtaaaagccagcaaatgactgatatctttggcctgaggatcaaccgagaggcgagaagaaacgctgtatgctccagatgcctgttcacgaatattaacacgtagatcttttgccagtgcgacgttaaaagcatcgagcgccatacgcgtcggcagattaacaggtgtccgggaatcataacgcttccactgtgaaacctgtgccacaggttcattttgttcttttacagtaaccgatgcgttgtccgtcgcgcgagttaatggtttacctgcggctaatggcgaatcagagtgtttgattgatcctaagtaacgcgtaattaacgccacgagtttgtcttctgcgacattaccgacaatgacaaacgtgatatccgctggagatgaaaacaattggcgatcggcagccagcgcatctgcggcagtaaactgtgcaatctgattttcttgcagtaatttcgtgcggtcatcagcatagcgcgtctcatacatctgctgggcgaatttctccgctggacgctggtcgagcgttttcaacgcctgaatttgagcattttgtagcgatgcccaaatattatcgttaatcgtgctgtgggtgattcgctggttaatcaactgaaaaccaggttcagggttattagtccgcgcgctaacggagagcaacgtattcatgccactgactttactgctcatggttaccgaattttccgcactccagcgtttcaggctggaagaggagagttcgccaacgccgcttccgctaactgctttatttgccagcgcgataagtgatttttgctgcgcagggaaacttaaatcgcctttattcgatacggcaataatttgtagcttttgctcttcacccgcggattttgccagaataaccctggcaccattggaaagtgttaatgatgtcagattctccgccagcgtttctttgctgctaatttccgcctgtgggtctgcgtctactgttaacgataaatttctgcctgggaagacgtaagccgccagctttttgttggcgtactccttttccagcgccaggatagccgcaggagacaatgcttttttggcggcaacctcattgtttaccatttgctcccaaaatgcgtcctggttctttcttaactgctgccatttttccgccagactttgcacggtaatttgctgccacagacgtttcgaaagttgatatgtctcttccggcgacaagaacggcgtattatttaatgagctggatgccaggcgactggtcagcatacgtaaatcacgttcagcttgctgatcaaccgcatttttcagccaggtgaggcgggtagatttgacatcatcgagttcttcagcagaaaaaccatgctgatcaatggttgccaactctgccattaatgcattcgcagcatcctgcatattatcgtctcgtgcatttacacggaaaaacagcgactgataatcgggtgcaattttaacgctgcgcgcagtgccgccagaaatagtcttcaactcgcccgactgtatgcgttcctgcagacgttgattgaacagctgaactaacatgctccattcagcttgttcgataaagctttgctcatcgttcacttgtaccattggcaggcgataatagagtgcgatgccgttcacccggttttctttatcattaatgatattaaagcgcaggtggttttcggcttttgtcggccagacgcgattttcagctgctttgttagccggaagcttacttaaattatcctttatcagcgccagcgcttctttactgtcgatatcgccgaccacgataaaggtcatattatttggttgataccagcgttgataaaattggcgcaattgtgccggtgtgaccgtggcgacagtatccatcaggccgataggttcacggtctaaattacgggtatttgccagcaggaaagggcggcgcgcctgagaggtgcgccatttcgcatcctgatgggcacgccattcctcagtaattacgccacgttcagcgtctacttcgagtttttcaaaggttgcggcattactccattcactgaagattgccatcacttgttgcagattttgtttctgcgtagtcggcaaactcacctgatacaccgtttcgtcatagctggtataggcattaacatcgcgaccaaaacgcaggcccattgactcaaatgtttcgatgactttattacccggccatgtttttgtgccgttaaacatcatatgttctacaaaatgagccacgccgagctcattgtcttcttcctgcaatgaaccggtatgaatttgcagccataaatttacctgatcctttggatgagcatgcggataaatcatatatcgcaagccattgtccagttgcccggtaattaacttttcatcctgcggtaaggcggcggcaatcagccgcccggggagcaacagagttgccactaacgtcagtaagaaacagaggtttctcataattatctccatgcgaaaaccgggcgaatttacccggttaagtaaaatccgaactattaaaatttcatgctgacatcaagccagaaagtacggccactggcgtaggtcgccacaccggtgttcgttgtatcaacagcggttttgctatccagtacattgagaatatcggcactgatcgtcaggttttgttgttgcagaaattgtggcgtccaggacaagcgggtgtcccaggtcaggctgctatccagtttttcgtcaacatactgcttgtaatctgaatattcgctgatgtattgcgcatttgtcttaccaaggataatgcgagctttacgcgcttcttgccaggccagcgtattcgcccacactaacccgctcggttgatgcgtgaaatccatgtttaaggagatctttaatgggttattaaaatctgccactggaacgctatcgtaagagaccagattaccgttataaaccacctggttatcaccggtattgctctcctcataaccattgtttaacgacaagttgcccttgctcttgatatagctaaagacaatttgtgggttaatatctacctggcggatatgcaggggttcggccagttcaaaactgaggctgaacgaatgcgttttggttttgccatcgttgttatattcagtaatggtggttttagtcgcgctgtcggtacgactgcttttgctgatttgatcatgcgcttcacggtaaacatagtttgcacgcgcaataacgttcttaccgattttctgctgcaatcccattgccagttcatcgttataaggcgttttcaaatcctgataacgcgtcagagttttattacctgataccgattccgtccagctattgcggatatcacgtaatcccatatcaagaatattcccgccatagtaacggttataacctgctgtaatcattgaggtttgattagcaaaaatatcccattccgtcataaagcgcggggagatattgtggtttgacagatagttgtcatagtcataccgcacgccgggcattaatgacacattacgccagctaatgcgatccgccatatacagcgtgtagttgtcaattcccaggcggcctttacctttatggtaaatggtatggttagttttctttccggcagcattaatcacataggattcagactggttatggcgttcagtccacgcatcggaatagatgtattccgcgccgaagtagggttgatgcgaaacattacccacggcgaatttttgccagtccaggcgtgttttgaaggtgtaattatctacagcctgggaaatgtgtcctaatccgccacgggtgcaacgccctgtaatatcaccatatgtacatgaaagttcggtgtaccagatgtcatgatcgtgacgggtataatcactaatatgatcccaaccaacggtggtacgcagtttggcccatgcgagctgcgtatccatatcccatgccagaccataggatttattacccatttcgcgatcagactgcgggaaggtgctggtattataatcacggctggagccggtatattttaaggttaaatcgtgggtaaagcggtcgctggcaaaccaggtaaatttgcttaatgcagtatcgataacgtttttatactgtgcccgaccggcgacaatgccgtcattcgaaacataatccgcgcgggtgatatcagactggcggcgcgataaaccggcggtaacgccgaagttatcagcgagttcctgattaaacgacaaggtataaaagttctttttaaaatctggggagtaataagtacttcctgaagagccttgattaaatgcgctcttgttattctcatcgatatgcgatgttaaccagtccgaacgcgtagtgcgataacccaatttcaccttgctatcatcagcgttgaagcgtttgatctttgcatcaattaccccgccattgaagcgaccaaattcaaccggcacaaaactgtcataaagcgtcacattgtccagtaagctgacatcaagataatacccctgtgacatcccgctaatattggttgcactactggcatcggactcattcgctgggttcaggttattagttgcactaataccgtcaatcaaataggcattctggtagggcgacgcaccgtgaatagagattttctcagggcgaatatctccctggttcaacgaggtactttgcgttgaatccatgcgtaccgcagggttggttctcagcagatcgctgatattgccattcccggtcggtaaacgctcgatgctttcactggtgtaatgcgtgttgccgtttacgggtacagggacaggagcatagaccgtcatctcttcaaaaaaatgcatgtacatgtttttgtcatcgacggcctgcgccacatcagcgccacataaaatgacgccaggaataagaactcgcttcatttatttatatctccgtacagcagggcttttattgtttttataaaaccgcgctaatgtcacaaatatcatcggccaggttccagacaccgggttgatgtgtaaccataatgacgccgcttgtgggtagtttttcacgcactaaacgcagtaagcggatagcctcttgttcctcaagatgagaggtagtttcgtcaagaaatatccatttcggacgtcgtaaaattaatcgtgccagggcgatacgttgtttttcgccgctggaaagaatatctccccagcgatcgtggtcatgaatacgcgcagccaatttcccaagaccaacctgatgcagtacttcgctcaacgatttatcgtctacgggcaggggaagtgctttacaaataatctctttcagtaagccggttttgattaacggtgtttgtgacacataccaactgtcagcaggagaagaaatatcacctttaaaccacggccagcagtgggataatgttttaagcagtgtggtttttcccgcgccagagtagcctttcagtaatagccatttgcctggcgaaacatgaaagttcaggttctctaatatgatcttattatcaggcgtacgaatactcgcatcagccacttgtaccgcatgttggcaatttttaggcttattcgtagggcgctgttcagtgagttgatggaactcatacaagcgatcgataaccgcagccagttcagcaagttcgtcatatttataaataaaccagcttaaattgttcgataccagcataaatgcctggcgcgatttcatcagtccgcccagattgatctgcccgctaataaactgcggcaataacagaaagtagggaagaacgctaagcgagcgcgaataaatattctgccagtaatcaagccaccgctgacgattcattaaacgatgccagttctctttaatggtatgaaaattgtcgctcaactcctggcgttgtagagactcagcattgcttagcgcaatcagttctgcctgcttattatgctgcacaagatttgttcgaaatgtcgcttcgctacgttgtttttccacattaagcggacgaatacgtttacccaccttatgggtaaataaagttccaccgatcacaatgagcacgacggtatagaccatatacccctggatattccattctgttccaccaacagtgaatgagagcgtacccgcgctttcccaaagaataacggtaaaggtgatcagcatgctaagtgactggatgaagccaaatgaaagactgagcgttttgctgatcagtaagagaatgtcttcagcgatacgttggtcagggttatctgtatttttatgctcgccgtagatctgcgtgaagtagtagtttttatctgcaaaccaccgattaaggtagtaatctgttaaccattcgcgccagcgaatagtcagtagtttaattaaccatgttttgtttacggatattaatacaaagatccccagcagggcagggaaccaaaggacaagctgccaaagcttatcggtttctttctggcttagcgcattgaaaaaatcattattccagtcgtttaaccagacctgaattttaaccacgccaaggatcatggcgaggataataatgattaacaacactgaagttttattattcttacgcagccaaaagggcttcaacagacagagatactttgctatcaacatacgaagcgtaatgggaatggttatcattagcgaaaattgattgtgccatccaatgattatctatggcaatgatttactgatgaaatttatttaagtatcatttaacaatatgaaatataaaggaatatttcattttcagtggttatggttatgctattgataatcaaggatattgctaatgccctgatgcataccacgtaagccaggattttcgcaagggaagatgatgatgacgaaacacccgacaggaatttatgtcgggtgccttgttaaggtcataagaaggaggctaagaatggagttaaaagagagcgttattaattattctccatttgttttgcaacatccataatgtggtaaagcggtactctgttcttagctaactctaccatggcgttcatataaggtaccatggttgaaaaaaggattttataaccttcgcaaaaataagaaacagtctcattgtttactttagtaatacgatgcttaggacaaccgccattgcagataggtttatatgcacattgctgacatttcgctggaatccgttttttttgcgctgtcagttgtacactgttcatcgttttgagttcagatttattaatgtttccaattttgtactgtggatagacaaaatggtcgcattcgtaaatgtctccattactttcaacaaccagattatccttgcaggactcctggaaaatacaactggtatgcccattccccaaaaaacggctgacaaagctttcaaactgacggatgaaaatttcacccacatcgtttttaacccattgcataaaaatggttgacataaacttgccataagccgtgggaggcacagaaaaatcaatgatacggaatgtgttctcactatgaccactgaaatcaatattcggcgtcccggtttctagcaattcgataaattgcatatgtttactgccgatagattttaaaaaatgataaacctcaagagggtaatggacattaacgttattaatgacggttaacgtattaaactctacttgatatgatttcagacgctcgatggctgctatcacttttgcaaaagtaccgttacctgaattactgcgtctgtaacggtcatgtaactcctgggggccatcgatcgagataccaaccagaaattcatgttctttgagaaaggcacaccattcattattcaataaaatgccattcgtttgtaatgcattaaaaatacgtttttggcctgcatagcgttgttgatagtgaataactttacggaaaaaatccaggccagccagagtgggttcaccgccttgccaggtaaaatagacctgattgccagacgctgcgatatattgtttgatgaactctttcagagtgctgtcatccatccatttttcatgagtaaactgcgactctttttcaaggtaaaaacagtaatcacatttgagattacattgaaaactggagggcttggctgtaacgtgcatcgctatctcgctcaataaggcggcggaaaaatccgccgcatgaaggtttagttatttcgcttcgcttagtgctttcttgatattgttaaacttctcctgatttacctcgctaagcggtggctggctgctgtcgataaactctcttaccacgccttgcatctctttaacgacctgcggattggcggcggcaaggttatctttttgctgtagatccgtcagtttgtagagacctaactgattgttttctactgtatagacaagcgaataatcgttatttctcaccgtataagagaattggcttaagtcctcagtgttggggttatgcgggtaatcgtctgactgatggcgaacaaatttgtggtaattatcccagaatggaatattttcctcgtcaaaccagtgagaataagaggttatccaggtcagatttttatgtggctcgccttgtttcttatcttgcaaccagggcagcaaggaaacgccatccagcttaaggtcttttggaatgctgatatcggctgcatcaagagctgtcgggtagaaatccattgcggaaatcagcttgtcataattaccgggttgaagttttcctttccaccacataaacattggggtgtgagtaccgccaggataggtctgactcttatagcctttttgcgccccgttcagcggcagaggaccatcgataaccgcaccattatcggaggtaaagagaataattgtattgtcatactgtccgtttttcttcagttgttcgagaatgcgttttacaccctgatcaacagaataaacggaagcgtagtagttatctgctgtttgactaccggtattaaattgcttctgatattgatccggtgcaggattatcatttggcaggtgcggagcattataagccaggtaaagcataaaaggctggtcaagtgttttggcacgatcaacaacgccaattgcctcatcggttaactgatcgctgatataaccttttgcggggacacgttcacgatttttgaacagtgaaggggagttgtaatatgccgttcctgcagcgtggaatcccataaagtaatcaaagccacggttttgaggttgccattcttccgcagaaaatgtggtgaagttgtcatgatagtcacgcgtttgtttatcttccggtaccggcacattactgatttttgacaagtgccatttacctactgctgcagtgtaataaccatgattctggaataattcaggcaagaaagtttctgttagcggaataccatcctgagcatcggtattggaatagacaccaaagcgggcgggagctcgaccggtcattattgcggcgcgggaggggccggaaacaccgtgtgccacatagccgttagtaaaacgtacgccttcatccattaatgaaaggagcgtcggcgttgatttttgtgcagcttcaatggctttatctatccctattttgtaggtatcgacaacttcacgattttccattgtttttgggtcaaaagatcccttatcaaaaggaagttgtccataaccaagatcatccatggtcagtacgataatatttggctttcctttggtactgtattctgtcggcgtaaagtctgagaaagcaacgtttgttttggttgctttcagctttacatcatctgccgcatgagcagcaaatgcagccataccagatgccagtatcaaagatatcgaggtacttacgacacttttctttaatgcagacttcataaatgttcctcttcttattgtacttaattccaaagtaattttacgaagagaaataagtggatgtaagtgaagttagtcacataaagagatagcagatttagctaaaaaaagggaaaaaacagtccataaagcgttgacattactttctgttctattaagtaatttctcgccgataaacaactaatttattgatatttaataaattattgcattttactgacaaaatgcagaattgagatcataaataatcatgcaacaggttatgcaagtgcataaatatgtgatggatgtcacttatttatttcaataaatatatcgcctaaaaacaacgcggggcagggaatggctgccccatttaattcttacgcagcgtgtgtggttgactactcgttagcaaataatcaaatagctaaagcattcatcgtgttgcccgtattcatacccgtgtgactttgacaacggtactccttagaaactctcttcggactgttgccgaaatgtttgcggaacgcataaataaaataagatgtactggcataaccacattgttcggcaattttattgactgaaccttctacgcgtatcaaattttttgcgtgctgcattcttgcatctaaaagaatctgtgagaatgtcgtttgctcttgcttaagttttttcttcaacaggctttcactgatgtacaggcagtcacaaatatctttcagcttccatgggtgcgccggcttcatgttgacaatatttctcactttcccagaaacggatagcacaccgttagttaatagtgtaatgaaacctttgcatgcggcaaaaatagacaggcaagaaaaaagcaaaagttctgaaaaattatgatgattgcgttcttccgagttgagataagcaatcatttcattaagcaatccagtcggtacatttgaagcacgtaaaaacttcgcaggaacaggcaccgtcactgtctggatgttagtgcattgtagatattttttaatggtattttcagtaaatccgatctctttaaaatgccgctcataaggttcaaaatgcgtacgaacagcgttatctaccatcaggatctcgccgtcagagaaggcgtaatctttatctaaaatgttagcgttgaaggcatgatgaataaatataacagaacaaacgagcgacattttatctccttaaaacaataaagtttttatcgatacttttttaacatttcatatttataatttgctgtttgttttcagccttgcaaactattgataatgaaatgtgtaagatctcttgcaatgcgacccatttctgaaatactcagctgatcaattgccgaaaaaatggctatcaacgtaagtgtcagtaataagacaaccacaattgcagacatgatttctttatagttgtctctttgcgtgattttgtttttcactgtggtcgcatgcatttcaaatatgtttatttagcggataacgttaaaaatcgttaatcagtatgcttaatataacaggctggagaaaagaggaaataggactggtgcttcagtactgagcggagtttcttacagctgtaggcagaagtttatatcttatagtatgtagtttaatttaatccatgtgagcaaattgcgaaataatagtcaatgaggaattcttctgctgtgcggatgacagcagaagaaatgagaagaggcattaatttgatggttctaattcaaccggaatacttttatagccaggaatgccacttaatggatcgtggttatcaagtgttagcatgtgattcgattctggaaaataggtcaccagtgagcggtcagccatagggtaaatgaccacttttaatctatccatgcggcgtgagctgcgcttaccgtctggcgtaagcgcaataagattaactctttcgccgttttttacacggcaaattttagcttgtttagcactcataaagaccacatctcgttgaccgaatacccctcgatagcgatcatccataccataaatcgtcgtgttgtactgatcgtggctgcgtactgtcgccatgaccagcttactgttaaacgctgaagagggatcttctaacagccctttgctggtaatgaaattagccttacctgacggcgtcatccagcgcctttcagcagctgcatttatcaggtgaaaaccaccgggatgacggatgcgctggttatagtcggcgaactctggcagcacagcttcaatgtcattgcgaatgcgatcataatcttccaccagatactcccaggctaccacgctctggggtagtgctgcctgcgcgattcccgcgaccactgcacactctgatttcagcattacaccggcgggttttaacacgccacgcgaggcatgaatcatcgacattgaatcctcaacggttaccgcctgcgcaccgtttttttgcatgtcaatctcgctacgtcccaggaccggcagaatatagctatgccgtgcggtcaacagatgagagcggttaagcttagtggctacgtgtaccgccaaatctaattgcgttaacggtacagcgctcgcttcccgatctggcattgccagcgcaaaattgccccccatgcagatcaatgctcgagcctgccccgtacatattgcttgcatgctggcaattgcagcatgtccaggtgcatgaggtggggtgaagccatagcgctcacccagacgagccagaaactctgcagacggtttctcggtgataccgacggttcggtcgccctgtacattagagtgtccacgtagtgggcagatacccgcaccaggcttgccaatgttacctttcatcaacagcagattgaccagttgctgtacgttctgggtaccatgttcgtgctgagtgatccccattccgtaacagataatggtgcgttcggcagcggcatatgcgtcagccagttcggcgatttgtgtctgacttagtccagaaatacgttcgatatctttccactcggaattgagaacgtcacggcgtagctcgtcaaagccgacggtatgcgtttgaataaactcgtcatcaagcaatgaaggccgacctgcggcgcttgcagcatcatcgcgctcaattaacaggcgcatcatccccttgagcaacgccatatcgccaccaatgcgcacgttatagtaggcactggccaactgagtctcagagttcgtcagcatttcaaacgggttttgcggtgcggtaaatcgctccaggccacgttcctgtagaggattgatggcgatcattttcgctccccgtttcactaaagcgcgcaacgaagtcagcatgcgagggtggtttgtaccagggttatgcccaatgcaaatgactaaatcgcacttctcaaagtcttccagcaacacggtccctttacctacaccgatactcgctgccaaacccacgcttgtcggttcatggcacatgttggagcagtcgggaaagttattgctcccgtattcacgggcaaaaagctgataaagaaaggcagcttcattggaagtgcggcccgaagtatagaattcaacctgattgggatcactatagctttgaaggcgtgcgccaatttcgtcgaaagcttgttgccagcttaatggcttgtaacagtcgctgacggcatcatatttcaaaggctgagtgagtcgccccgcagcctcaagctcgtggtctccccaggtaagtaatgattgaaccgtattctcagcaaagaaagaggcgtttacctgcttatccgtgacttcccaggcgattgcttttgcgccgttttcacaaatgtcgaatgacgcactgtgcttaggatctggccatgcacaacccggacagtcaaagccctctggcttattcatgtcaaacatggcaataacatcctggcgtatatccatctgcttacgtactgcattcgctacggatttaacagcaccccaaccacctgcagcaccctggtaggattcaatttttttcttcatctacttatcctgtgtggaaatgaattattaggatttgtaatagcgatgatgcacagtacatacaaagggattatcgccaacatggatatataagagtaggggactactctctttctatttttaatctattatcgttaaacaatagattaaatacgataagttaagcatcatctctcatagtgtttaaattaacatatttttcaatataaaaaataagactctggcttcaattgtgcgcggattttcttacaggtgtaggctaatagccttcacaaaataattatccgcgcaattttcgtgaatggagcgcatagactaaggtcaaaatcacaattattcatagataaaagtgacaccaatgactgactggacggttccggctgaaaccttgtttcctgtttgtccataggttgcgcttaaacccagaggtactttgcttttatttactgtccccagggagacattttctcccgtagccagtatttttccattacgcattagagtgacacccactcccgatgcttttgttgcatcaggtgctgtgttagcaaacacttgtcggctactgtcagtggtggcacccgaaagataaaatgagagcttttgttcgcttgagcaatatacgccaaggggtatttctgcgcttccaggaaagtccgggagatccacggtgacatttcgactatcaacggtgcagccgcctgttggcataacaacattgttatttgaaataatattccacgtaaaattacgcggatttccgcttcctaatgttgcaattttatacatatgaatacgggcaatgacttcccccgcttttatgacaactccaccggccgccccaactggggtaatatagagttttaacggtaatggcatcggtgtcttatcaccaatatccaatacgttggtatttgtcgtcaacgggaaggggtaggtcacattattccagtacagcgatcctttatatgactgtagggagcctgcgaaagctgagccttgtaccaggtttatatgatcagtgtcgtaccagccgccgtaatcattccagcaacttatatgctgagacaagtctacaaccagattctggcccggctgtattacagggtcgagattaacataaacagaggttgtacctgctccaatacttgacccgccatcgacattacaactgaaggcaaaaactttgcctgccattaatagaagataaataccgaacaggacctttatactgattgttttacccatgatatatcctaaggttaaaaattgatttaaaaagaaggctaagaaaatcgaatcgacgttattgccaggtgtagatcacattgattagcgcctcgatcgttccctggcttgcgtttccattcaccgtgatagctcttgccttaagtggaaactgtgcattacgagtgatctcatcaacaataaccgttttgctatcgccattttttaacgcagcatcctggtcatccctcagctctatctgaatattttcggcagtaccttcatttttgtaataacccgtattgtcagttgaacctgtcacgattgccgtcactgcacttgtttcaaccggacaatcggttaatgacaaagtaatattgtgccagccagatgcagaaccaggttgttgcagattgcgcgtataaagatccccgagattaacgttagcttctttggtttgaatagtgcagggtttagcgactacccgaccattaacagtgatagtgacatcggcggcctggagagttgctgtgaataacgcgcaaaacgtagctaacaggaacctcttgtgaagtcttttcatatctgactctgattattgaaattcaagggtaaaggttgccgaagccctcaccagtcccggattgacggacttctgagttgacttcagacgagcggagtaaggcaaaatattgttctgttctggtaccagtgggatccactgcatcccggcatgaagatcattcagtttcaccggacgcatatttgcgtccaatatttctatacccaaaccggaggccgtattgcttccttcatccagtttcaacaaagtattattttctgcatcctcaataccgttaaatgcaacccgaacccccgttgtccctttgctgcattcacttaacgtaatctgaaaagggacggctggacttgtgctaccggtcgttggaaattgtctggcactgtttttttggagatctacggtaaaattaagcgaatccgatgagactgtgcagccataatcgaggacgcgcccgctaattttaataacgctatctgcggataaagcagaataggtggttaaccccagacataaaccgaggaaaataatgttattgtatttcataatctattgttccttagcgacagattgctgtctgctggttcagtaaggtaccaggagaaacttcaggaagcttgtactcgacaatacagtttgagtttttatctttgccccatgaaacctgtaattgccctgactgtggaagtccagtcagataaacctgaccattttccgcgacaatgctgccatttttattctctccgtgtgtgacaattgcaccgaatggaacgctcttattaccgtacttcaacgtcattaatactttcccgccgatttgtgcattaaatgttgctctggcaatagcaccgtgagttgggatgacagtgaccacggtttcatccagttcaacattatctgcaagggaattcgcgttaagagcaacacggttttctctatattctgtcgcaaatggtaatatggcatagccacgccagtcggtatgaattccggtctggttctctattttgacattatcagcaccaggagccttaaccagaaccattgtgtcgcccagcggctgtccaaaggtgatgccatcagcatgagcaataatcccaccactcattccgtaataaatctggctgctgtcaccactccgactgtaaccgacattagtattaccataagctccacgataattaagagaactgtaaccactggtgccagacgatgtattacctccgtgggtgttaccgacctgaacgctataattcaggttattatccggcagcagagtgccataaacccccgatagattggtcatgccgcctttcaaatcgtttgacatactgtaactggcgtttgaattacgaaatgccgactgactgtctgtacgcatccaatgactgaagggaacattaagcgtaaaagcgagtaaatgatcccgatcgttttgccatatattattggaatagctgtaattcagcgaagtcgtaatatcaccaaacggcacatttaatccaaatgatatttgctggtcgctgcgtgacgtgttccagtaactttggcgactggcactgaaaaatgtcgtaccgtaatttccaagctgctgagagatgcttatttgttcctgaccacgcttactgtagaacagattaaaataatcaataaattgtgtctgctcattggtgtctccggtaggaggcttgacggtgtaaccactcattcgactgtaggcactgtcggataagttataaaaaccttgcgtagaatagcgatatcctgcgacctggatattggttccacaacaagtttattgctgcacttgttgaagagagtatttgcaaaaacattttatgtcgctaaataacatgacgatttcattatgcatgttatttataaaccgtgactaaacagaatattattgcgaacaagggaagtgtcaggaaaggtcaagagctaccaatggttaatatggctataaatcattagctatggttaatgtttgcttgctgaaactaacaccgaattgctctaaacagataagtgcagggtttattaaagctgtccgacagactttcttaacctggtaatatctctcttgggtgactctccaaacatccgcgaatattcccgactgaaatgggatagctttcgtaaccgacagcataggctgctgtggtgacatcgtaatgttcattcagcatctgtcgcctgacttcattgagacgtagccatttctgataccggagtggactcattcccgcttgatccgtccttaaataagtaacagcaccctctggtgttttcgtatgcagtgtctatgcgacagacactgcgctcttagcatggggcagggaataaccaggctatttctccatgcacaggccaattatgaaagaggagaggcttaagttcttgaaccctgaacgaataacgactaccagaaaagcacttcgcatcactcagacatgatttaacataatatacattatgcgcaccaatataaaccaaggaagaatccagtcgttggcggtcatgattgtcatgctcattaacaatgaccaaaccccatatctcacttactaccgtattctcggcttaaccgtccatgcaacctcaacacattgctttcaactgccgtcaccacgttctccggaaaatctgtcggtaatgaagtcttcacgttatccagtgctgctggaatcattctggcaaagtcactcaggatttcatgcatctgcacttccgggaatctcagcacctttgctgtcgccaaaaaatgtcgcggataaattttatcgattgccgtttttttgcctttggatgcgttaagccccattgccagtttgagatcgctgatgtgtattcccgtaccgccaaggaccggaaatgctgaaatgatgtcgtaaaatggcgtgagtcgataactgccgccagcctgaataaatacggagaagttttttgcatgaccgtccgttgcgccaatcaaccactggaagacctggaatttcataaaatcatagcgatctttcagcgcctcgctggaccccatcaaaaaagccatgatccgcgcgatgcctgggcctccatctgattcatatttcaccgatgaaggtaaaccgaatgtctgacacatatcctcctgtggcaagcgaagtaaaaccgttcgctcagcattccaacgcctgtcaaaacgttcgaccgctaacgcgcgcacatttcccgctttaatgatttctgcgtccggaacattcaacccaagttctttcgccagcagcagacagtaatactcattatcaacgctttggctgagatcgagcgtcgcattgggctgcctgatttcgccaatcggtaatttaatgatgtgcgtcgtcggcgttattcctttcggaatgcaccagtcattgcctattctgagcagtgctgtcttctcctgtgcgccagcaaccgagatgcgaaagtcattttcttctctaatcatgcctagcgggatatctgctttataagccgttaatacttcttcaagtctggcttcagtaagcttttcccatgccattatcggatgcgttacggtttcgtcttcgggtattaacgtcacggcaccaacgctgtctcgccctatttctgacaataaatcaaacggttgtctggatttggcatgataacgtttaacgatccggtcacgtacaatcgggctatcgggtaacaggttatcgaagaagttaaatacggcatcagaggtgatattccccctctgcaatggcagcgaaagtgacaacggtctggcataacggcttgctaaccactccggtgcatacttaaaggtgtgcgcgccgttggctaacttcgttaactcgcctacccgctggttgttcatccaagtgacaagtttaggcattaccactccagattttgctgttctgttgattctggcgaggcatttttcgcgtcgcatagcgtcattgagagttcaagcgactgtaaaatcttaaaaaatgtcgtgagcgtggtattgtcagggttgttttcgaaattggaaatcgtcgcctgcttaataccaatttttttcgccagctcgctctgcgtccagccattttgctggcgaaccagtttcattgcattcgccaattgcgttgggctatagatcttctgaaagctcatcatgtcatacgtccacagcaagtttatccgcttaaggggatattataagttttatcctttagtgaggataagtcaatctggaaacacatcttatccgctctacgggataaacgctgcgatatccgcgatcgcggataaaaaggaggatttaaataaggcgttgatgcgccgtttgaagtcggcaatattaagccgcatgccatctcgacatgcggcttatacggtttaccagctatatttcactcccagcatgccctgagtatcgctatagcctttatcacctagttgcacaccgacattcccccacaggctaaggttgttatttactttcgcctcaaccccggtacgtacttcaccgagattacgcgcaccttcacggcctacggtttgaccattcatcttcacggcgtagactttgctattgttgatccagttcgcttcaatgtaaggctggaactcacgctgtttaccatcgtcacgctggtgatggctgttcaggtaggttttcaccccaagtcgcgtttgcacatttccgtcgccttccgtttcaatgcgcgttccgtctttccgggtatggtcggaatctttcacacccatccaggtgatttgcgcctgtggctggacgtaccaggtattcagcgtcccttcgctgccgctaaatgttcccgcttcaaaggtatacccaccctcaacagaggccgtcacaccgcgagaatcatagtcgtcagcagaacggttatcggaactgacgctgttatcaaaccagttatacagcgcccagctgtcaacataagcgccggtcttattcgcatcgttctgataccaggtcgcgtacagcccagcgctgtaaccgctgatgcgcccatccgatttataacccacacgattactctgagtattactgtgctgattggcgtagcctgccatcacgccaagatgccagcgatcctgcgcgttgctactccactgcgccaaatcgccgcctagctgcaatacatagcggttagcctgagtatttagctgaccgtcaccggcccttgaacgttcgtgccctccgacatgacgcatccacatactgcttgccgacccctgagaatgcagtgaatctgtatactgcggctcacccagacggtcgtgtaaacgatggctaaacagcgagttggctgcggcaatgttgctgatatagcttccggcctccgggcgataaactgatgggccttccggatccacaacagggggattattgatgggatcgggtgtatccgctggcgttacgccgtcccatttactggtcagataccagtttttctcgtcattccccttccctttagccagcgtgtagacgtaagccccagcttcgacagttccggtggtcagcgcgaagttacctgcagaattaccgccaacctcaatgagttcaataccgttgaccgtttgtgcaccgacgccgccaatgttatcaacccgaacgcgagtgttcccttgggtatcgcctttcacgttcatcttatcggtgggcgaattatcgccgcccagcgtcgcgttgaacgtcatcaggccattgtttccggtatagttgccgttaacggtcagtacattccccggtttccccccttcgctattcatttgaaccgtgccgccattctccaggttgccgccgatagtggttttagcgacacgcagtgccccccccaggcataacgttcatatcacctgcagtggtgacatttcccgacatcacaccgctgttatggatattaatgtgttgacttgccatattaatggcagagtcggaaccgaaagcaatttccccccccacgatatccgtcgtaccctgatacgccgcggaatcgttgttaagagtcaggatcccggtacccagttttgtcacatcaccgctaccgctgatactgtgcgtcatcgcccagctacgctcagtggagatggtgagcaggccattattgataacggaagcatcacccaggtttttctgctcgttgacgctgagcgcgctgcctgtatcaatgttgaattgccccacaaagcggctattatcgccatccaactctacatctgtcctggcggttgcgctcacgatacccttcccgcttatgctattacgcagttcgccagtcacgttttttagcgttaacagaccgtcattggcaatatttcctctgcctaacccctgagtattatcgaggctgacttccgcatttgggctaatgctggttaacgcattgtagcgtgcattaagcccctcgatagccagcgttccccctgtaacattcaggtttccgccacctgtcagttcaccctgactgatcccacctttatttaccgtcagcgccccctctttgaacaaaacagtcgaacccatctgcccggtgaatgtctctaccgtctgcgtcgatccattaagatcgacgatggccgcgttgctgatgttcagttcccgggtgttgccaagtgcaccatccgcatcggtacgtaatgtccccatctgaacgtaggttgccccctgatagtcgttctgaccgttggaaagcgaaacctgtcgcaccgtattgattgccagatccccttcaccaccgatttttgccgacatatcggccgttgcgccataggctccgccatgttcggctaacgtcagcttttgcccaccatggatgttcagcgctttcagcccatagttaacgtacaaaccattacctggtgcggtcgtgaggcggaatccataatcaccctcggcgaccaccgttccgttttgcgcaatgtgtaacgttttgtccgcttccacctcgtcgccctgtaaatcacgtaacgttaatgagccacccgacccaataaccgtttgcgccttcaccagttgaacgccgacatggctatcgtcgtgttccagcaaattgagcgtcgtcagagggttattcgccatgggatcattccacggtttaggcacgtcgataagcacgtcgcccgtcccgtttacctgatagttacggcctttccaggtgtagtcacccgcgccgacaaccagcgtatcgacgctgatatatccctccgcgagcgtcgcagcaggaatatccgtatcgaaaatgatggtacctccattcatggccagtccaccaatggattgctctccaacttttaccgatgtggtattttcactgtcagactgcaacatcgcgtgagtaagcgcagcggtgttgtcgcgttccagagtgaaggtactgtctttcagttgggcaacaccggcgaattcagtccctgttgcatgggtaaagccaaacatcttgtcggaggatgacagctgcactcgcatcaagccatcgcctttgagcgcattggtcagcgtgtaatctcctgcactgttcgttgatgcgagaatgtcgagcgtaccggggtttgcaatggttacttcactcgaccccatgcccgttaccccatctgccgtatgagacgcaatggtcaggaggccgtcattgaccagcgttttaccgctataagtattccctgcattgaacaccgtatggcctgcatcatggatcacttttccgtctttatcgtcacctgtaatcagcatatcgacctggtagccggcatcactgttattggtatgattaaagacaaaaacgccttcgccaagaccaaactccactttcgtcgcattggtgataaatccggcatctgccgccgcctcaccgtgagcagcaccaatgtttagcgttcctacagcaggctcaaaaacacctaagtaaacttctccaccttcgacattcagcgtaccgttattcgtcagggttaacgtacccgtaccagatgtccctacgtacatattgaatgtttcaagaagagagttctgcccatccaccctcacgtcgcccttacttttgtcattgagagctatctgtgtatcacgcgctttaactatacctccggtggtaatattcagttcacccgtgcctaatacaccgacctgtagcaattgtgcgttagtagatgatgtctttaaattccagagactgtccgttgaaatattaactatccccttaccggaggcatttcctccgataaatccatagcccgttgaattaagggtggcaccattactgacatttacgataccgctaccaaaattaccgacattgatacccacagtatcgaacgatgatgtcgcatccatcaggttcagtgtgccgataccgcttgctttatcgcccaaaaaagtaatattttgcgatacgaacttaccgccatcgctaatattgaggtttccgacgcccgcaacaccaatggtggtatagacattcttattgacctcccacattccccccgtggtgatgctgacattcccgacgccggtttctccataaccgagtgaacttcctccgttgctgacaacaagcccctgattactgatattcatttcgccgtggccgtcataaccaagattagttccgagattagtgataacggagttcttatccttaacagtaatgttgcctgtgcctgtttctttcatccccgcagtgataattcccgaatctactttgccttcactcgagacattaagttcaccgtcgccagcatcaccgatatagatatagcggaaagcttcgcccgttccgaggaaattccaatgccctttatcggtcacgttgacgacaccgtgggaaccgtcctgaacgcccaccaatgaatattctttgttattaatcagtccattattggaaatattgactgtgccattaccgaaatatccattatagagtctgcgtaccgtgatgacagagtcttgatcctgcacattcagggttccgataccggtggcattgccaccgataatcgtattttcagccgtaaccaaccccccctcgcgaatagtcgcctccccagttccttgattaccaatttgaaattcaattgaggaatcattattttttattagccactcgccacccttttcaacgacaacctggccattactgcccgcctgatagcctaaaatggcgacgattgaactcgtgacgtaacccttatccgtaatatttaatgaacctgtgccatagctacctatttcgaataattcggtcgtcagaacagagtcctctccctcaacattgaccgtcccgacgcctcctgtcgaagaacctaatcttaaatagcctccatcgacgtgacccttctgtttaatattcagcgtccccgttccggattgacccacatttaaaggccttgcattatttccgctatcatacaatcgccaggtgccacccaaaacattaacggtgccctctgagtcctcattagcgccaatgacgctggtagtaatagtggttaaggaggcattaccgccagccaaaatattaagcactccagtgccataccagccaaccaggtaggcatcataagcaacatcagtatcaatattggtaatctgatcattatcaacttccagacttgcaccagacgctgaaccgcttagtgccagcaaaacacccagcgtcaatctactgaatttcgttgtcagtccagaggatttacgcaaattaaccgtcgatgttttacctgccctgcgagttaattccgagcaggcctgaaatacctgtagagtgcaattccatatcacgcgatagattctattcatataaacgctccatatacaaacaatacagccacgaaagagatgagtcgtcagacattaaaaatgaaacttattaaattgtcagaggtctgtattgagtgttagttggaggtgggaaggtgtcaatttggctaatttgctaatgctttcgaattgatagattaaaaattgcatagttcttattttatttaaatatgaactatgagttattgttgcttaataagaaaactgtttctttcaataggaaaattatcatcatcatatttaacaaagaatagcactaattgctaaaaatcgaagtttattaaaccccttttgcatccattagtgtctttaggaatattcgctataaaataagggttgtgcttaatgctttaagaaaaatagcaattttcccttgaatatcgtactggtgatggaacgatgaatctgcaagctggcttttaacaagccagctctaaaagaagggaaataagaataactatactcaaaaactaacagccacggtcatcatgatgtggctgtcaatgaaactataacccaggcgctttccataacgacgtcgtcagtccatgatcaaccagccccagctgatcctgataaactgcctgccacttatcgcgtgaatcctgataaagttcatgcttttccgggtctggtgtgtgcgtccgttcccagcgaaccaggcgttctccggtttctgccattgatgaaaaaattccggcaccgacgccagctgcaatggcacatcctaatgcagtggcttctttgaccaccggaatattgacgggtaatcccgagacatcagcgagaatttgactccataatttcccttttgaacctccgcctgcaaagactaacgatgaaggatgaatattcgagaaatcagcaatttgctgcaagttacacgctgatacaatcgccgcattttcttccagcgcacggaacaatgtcgctttgttacatttatccgggtcaatggacaagttaataaaggaaggcgcagcgtgataccaggttttaaagcgcattctgtcggagaagatcggcattacgccccacgacccaggcggcacccgactggccatctcttccagcagcgtataggtgtcgatgcctaaacgttcggcaatcagtttttcttcggcacagaaagcatcgcggaaccagcgcatggtgagtccggtaaaaaagcttatagattcagcttgtaccatgccaggaataacatgaggattaacgcgcacgttcatttctgggtctgtcaccggcgcggctaaatttacaacttgctgccagaatgtgccgccaagaaccgcggtttgtgccggacgcacaacgcctaacccaaggcaaccaagctgcacgtcgcctcctccaacgaccaccggagtgcccgccttcagaccgcagagttccgccgcttgtgaacttaccacgcccagcaatgtgccggtttctttgacaggagaaagaatatcggcacgtaggccagccatatccagcaatgcaggtttccagtcacgggtggttagatcaagaagtcccgtggtgccagcgttagagggatccaccgccagttcgccgctgagcatataggccagccagtcgctgatcatggtgatggttgatgcctgacggtaaatatcggaacgatggtgcgccagccaaagtaatctggggatggcacttaaagccagtgtttgtccggtcgcgcgataaacttcgttttcaaaggtattgttgtgcagttctttaagttcgctaacttcgcgtgccgctctggcatccacattggcgcaggcccagatcggggctccttcattattatataaaacaatgccttcacgcatcgaacatgccgaaacggcagcgatatactccggggctatgccggcgttgtgcagcgcctggcgcatacactcacacgccagttgccagtttttgttgagatcaaattccatagaaccaggaacgtccggtactgccagatgccgccactccgcctgtcccactgctatttgattgccttccaggtcgaatatcacagcccgaatacttccggtgcctgcatccagcgccatcaggtagtactttgattctgaaagggtaaagagtcgagccattagattatcctcggcttatgcgttctgtctgttcctctatacgttctccatcattcccggtaataaggtcatgcaaatttaactacgtaaaatcgccgctgctgtgtcctgatcggtaaccagtgcgttgatataaccgcctttcattgcagcggcaattgcttcggctttattttctccccctgccacgccaacccggacgggtatggtcttcagcgcgcttaaaggtaagccaatcagttcgttatgtattttgatattcgtgacaacgtcaccttttgcatcaaaaaagtagcctaaaatgtcgccaaccgccccttttcggccaatcattaactgttcgccctggctgatataaccggagcgaatgattgtcgcatcgtcctgttgactcacagcaccaatgccgacaatcgccacatccgctgcttgcgcggctaacagaacatctttgacgcaattttcattttttagcgtacgggcaatgtcagcggaggatgcccgcaacggagccggaataatattcacactgcacgccgcgttaagctgcccgattcccgtcatataagaaccgacgccaccggagagcgtgaccaggcgaatttgctgtgacgaaataaaaccacttaagcgttgcagcgtattcatggttgcctcgccaaaaccaatcgccagcatctgttgtggttgaagtaaactcatcaacatatgcgccgcgcctatccccagtcgcccaccgacatcagcatccgcaagcccagggatcacccggacatgttgcagcgaaaactgacgacgtaattgagtttcatattccagacagccttcaaagcgagaattaatctgtacgcgaataatgccggactgatgccctttctccagcaatcgcgacactttcaaacgtgtcaggccgagacgatcgctgatctcgctctgggtcagcccgtcgtgatagtaaaaccacgcgatccgcgcgacctgttcttcttcacacattccctgttctgaaattgccgaatcgttgattgtcataattcattcttcactttgaacatatttaaatctttaatgcaattgttcagttcttgctcatttatatctgtgatggcaaccacagtttgactctacgagcatgaacaaacgcaaccgtgaaaatcaaaatagcataaattgtgatctattcgtcggaaatatgtgcaatgtccacctaaggttatgaacaaattaaaagcagaaatacatttgttcaaaactcacctgcaaaactgaacgggggaaatatgcaaacgagtgatacccgcgcgttaccgctactttgcgcccgctcggtttataaacagtattcaggggtcaatgtcctgaaaggcatcgattttacgttgcatcagggggaggtccacgccctgctcggcggcaatggtgccggtaaatcgacgttaatgaagattattgccggtattacccctgctgatagcggtacgctggagattgagggcaacaactacgtcagattaacgccagttcatgctcatcagctgggtatttatctcgttccccaggaaccgctgcttttcccaagcctgtcgataaaagaaaacatcctgtttgggctggcaaaaaaacagctctccatgcagaaaatgaagaacttgctggcggcgctgggctgccagtttgatctgcatagtctggcaggatcgctggatgtcgccgatcgccaaatggtggaaatcctccgcgggctgatgcgcgactcgcggattctgatcctcgatgaacctaccgcctcgcttacccctgcggaaaccgaacgcttgtttagtcgcttgcaagagctgcttgctactggcgtgggtattgtttttatctcgcataagctgccggaaattcgccagattgccgatcgaattagcgtgatgcgcgacggaaccatcgccttaagcggcaaaaccagcgaactgtctaccgacgacattattcaggccatcaccccagcggtacgggaaaaatcgctctctgccagccaaaaattatggctggagttacctggtaaccgcccacaacatgccgccggaacgccggtgctgacactggaaaatctgaccggcgaaggtttcaggaatgtcagcctgacgctcaatgccggagaaattctgggcctggctgggctggtgggggccggacgcacagaactggccgagacgctctatggtctgcgtactttgcgtggcggacgcattatgctgaatggtaaagagatcaataaattatccactggagaacgtttactgcgcggtctggtttatctgccggaagatcgccagtcatccggactgaatctcgatgcttcgctggcctggaacgtctgcgcccttactcataaccttcgtggattctgggcgaaaaccgcgaaagataatgccaccctggaacgttatcgtcgggcgctgaatattaaattcaaccaaccggaacaagctgcacggacattatccggtggcaaccagcaaaaaatcctcattgccaaatgcttggaagcttcgccgcaagtattgattgtcgatgagccgacgcgcggcgtggatgtctcggcccgtaatgatatctaccagctgttgcgcagcatcgccgcacaaaatgtggctgtgctgcttatctcctccgacctggaagagatcgaactgatggcagatcgtgtgtatgtgatgcatcagggcgaaattacccactctgcactgaccgagcgcgatattaatgtcgagactattatgcgcgttgccttcggcgatagtcagcgtcaggaggcgtcatgctgaagtttattcagaacaaccgtgaaatcacggcactgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcttgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggcaaatggattgaagggttacccgccgaactgaaacagctctccgccccgctgctgcttggcgtttcagcaattggttggttgacgataattctggtggcatttatggcctggctgctggcaaagacggcgtttggacgcagtttttatgccacgggcgataatttacagggcgctcgtcaactgggcgttcgtactgaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggtggttccggtgcgatcattggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataatgcgtattcgctacggttgggaactggctcttgccgcactgctcgttattgagattgtcgcatttggtgcaattaacccgcgaatgttagatctcaatatgttgctgttcagcaccagtgactttatctgcattggcattgtcgccctaccgctaacgatggtgattgtcagtggcgggatcgatatttcgtttggttcgaccatcggcctctgcgccattgcattgggcgtactgtttcaaagtggtgtgccgatgccgctggcgatactcctgaccttactgctcggcgcattgtgcgggctgatcaacgccggattaattatctataccaaagttaacccgctggtgattacgcttggcacgctgtatctgtttgccggaagcgctctgctgctttccggtatggccggagcgacggggtacgaaggtattggtggattcccgatggcgtttacagatttcgctaacctggatgtgctgggactccccgttccgctgattatcttcctgatatgtctcctcgttttctggctctggctgcataaaacccatgccggacgtaatgtgtttttgattgggcaaagcccgcgcgtggcgctttatagcgcgattccagttaaccgtaccttatgtgcgctctatgccatgacggggctggcgtctgcggtcgccgctgtgctgctggtatcgtattttggttcagcacgttccgatctcggtgcgtcgtttctgatgcccgccatcaccgccgtggtgcttggcggggccaatatttatggtggttccggttccattatcggcaccgccattgcggttttattagtgggatatttgcaacaaggtttgcaaatggcaggagtgccaaatcaggtgtccagcgccctttccggtgcgctacttatcgtcgttgtcgtaggtcgttccgttagcctgcatcgccagcaaattaaagagtggctggcgcgtcgggccaataacccattgccataaaggatatcttcatgacacttcatcgctttaagaaaatcgccttacttagcgctcttggcattgccgcaatctctatgaatgtgcaggccgcagagcgtattgcatttattcccaaactggttggcgtgggattttttaccagcggtggcaacggcgcacaacaagcgggtaaagagctgggcgttgatgtgacctacgacgggccgacagaacccagtgtttctggtcaggtacagttgattaataacttcgtcaatcaaggttataacgccattatcgtttctgcggtttcgcctgatggcttgtgtccggcactgaaacgcgccatgcaacgtggtgtgagagtgctgacctgggactctgatactaaaccggagtgccgctcttactacattaatcagggaacgcccgcccagttaggaggtatgttggtggatatggcggcgcgtcaggtgaataaagacaaagccaaagtcgcgtttttctactcaagccccaccgttacggaccaaaaccagtgggtgaaagaagcgaaagcgaaaatcgccaaagagcatccaggctgggaaattgtcactacgcagtttggctataacgatgccactaaatcgttacaaaccgcagaaggaatattaaaagcgtatagcgatctcgacgccattatcgcccccgatgccaacgccctgcccgctgccgcacaagccgcagaaaacttgaaaaatgacaaagtagcgattgtcggattcagtacgccaaatgtgatgcgcccgtatgtagagcgcggcacggtgaaagaatttggcctgtgggatgtggttcagcaaggcaaaatttcagtgtatgtcgcggatgcattattgaaaaaaggatcaatgaaaacgggcgacaagctggatatcaagggcgtaggtcaggttgaagtctcgccaaacagcgttcagggctatgactacgaagcggatggtaatggcatcgtactgttaccggagcgcgtgatattcaacaaagagaatatcggcaaatacgatttctgatgtgcattacttaaccggagtaagttatggcagatttagacgatattaaagatggtaaagattttcgtaccgatcaaccgcaaaaaaatatcccttttaccctgaaaggttgcggtgcgctggattggggaatgcagtcacgcttatcgcggatatttaatccgaaaacgggtaaaaccgtgatgctggcttttgaccatggttattttcagggaccgactaccggacttgaacgcattgatataaatatcgccccgctgtttgaacatgccgatgtattaatgtgtacgcgcggcattttgcgcagcgtagttccccctgcgaccaataggccggtggtactgcgggcgtcaggtgcgaactctattctggcggaattaagtaatgaagccgtggcgttatcgatggatgacgccgtgcgcctgaacagttgcgcggtggcggcgcaggtttatatcggcagcgaatatgaacatcagtcgatcaaaaatattattcagctggttgatgccggaatgaaagtgggaatgccgaccatggccgtgactggcgtgggcaaagatatggtgcgcgatcagcgttatttctcgctcgcgactcgaatcgccgctgaaatgggggcgcaaattatcaaaacctattatgtcgaaaaaggttttgaacggattgttgccggatgtccggtacccattgttattgctggcggtaaaaaattaccggagcgcgaggcgctggaaatgtgctggcaggctatcgatcagggcgcttctggtgtggatatggggcgtaatattttccagtctgaccatccggtggcgatgatgaaagccgtacaggcggtggttcaccataacgaaacggctgatcgggcatatgaactctatctgagtgaaaaacagtaactgcggatctaaggagaagaattatgcacgtcacactggttgaaattaacgttcatgaagacaaggttgacgagtttatcgaagtttttcgccagaaccacctgggctctgtacaggaagaaggcaatttgcgcttcgatgtcttacaggacccggaagtgaattcgcgcttttatatctacgaagcctataaagatgaagacgcagtggcgttccataaaaccacgccccactacaaaacctgtgtcgcgaaactggaatctttaatgaccgggccgcgtaaaaaacgtctgttcaatggtttgatgccgtgaggcgaatttatcaattttatctacaattggggtaacgcgctgacgggagtaaaaaaatgtctgactggaacccctctttatatctacacttttccgctgaacgatcgcgtccggcggtggagctgcttgccagagtgccgctggaaaatgtcgaatatgttgccgatcttggctgtggcccaggtaacagcaccgcccttctacaacaacgttggcctgcggccaggataacaggcatcgactcgtctccggcgatgattgctgaagcgcgcagtgctttgccagactgccagttcgtggaagcagacatccgcaactggcaaccggtacaggcactcgatctgatttttgctaatgcctcactgcaatggctgcccgaccactacgaattgtttcctcatctggtttctttacttaatccgcagggcgtgctggcagtacagatgccagataactggctggagccgacccatgtgctcatgcgcgaagttgcctgggaacaaaactacccggatcgcgggcgtgagccgttggctggcgttcatgcttactacgatattttgagcgaagccggatgtgaggtcgatatctggcgaaccacctactatcaccagatgccgtcacaccaggcgattatcgattgggtgactgccactggattacgtccgtggttacaggatctgaccgagagcgaacagcagctttttcttaagcgctaccatcagatgctggaagagcagtatccactgcaagagaacggacagatactgctggcatttccgcgtctgtttattgttgcccggcgtatggagtaaatatcacgtcagctggtaatgacgatcgggaagaatttttgctggaatttcggcttcatcgttcatctgtaacaggtcaatttcaatagcgttgcagatggcatccagtggtaaatcattgttttcagtaccgaacggatcttccagttcttccgccagacaatccagcgaaataaaagtgtaggaaatcagcacagagataaaaggcgtcatgtaatgcaggtccacgaccagcgcgaacggcagcatgatacaaaacagataaacggtacgatgcaaaatcagggtgtaggcaaagggaattggcgtataggcaatgcgctcgcatcctgccaggaccgctgaaatatcattaagccgatcgttgaggctaataaacaggatatctgaaagctgtccattgcggcgctgaaccgccaaccattctcccattattaacaagatacggttagctggagagttcgaagccagtacacgctgaagatcttcagtcttgagataatgagccagcacttccgcctgtggctgtttgcgtaatgtcatgcgtaaacagtgggcgaaagcgatttgcagccgggcaaactcccttacacttgccgaatccggcaatgtcgtttttacctcgcgcagtaacgaccgtgaggcaatcatcaactgcccccaaagttttcgcgcttcaacgtaacgggcgtacccggcattattacgaaaaccaagaaaaatggcgatggcgacaccgagaatgctgaacggtgcgagggtgaatttgatgcccagatgcgtgtaccagggcagcatgaaaataacagcgatagaaaagagaaaattgagtagtaagcgcgaggatatcttggataatactgagccgtgccagacaaaaatacggcgcagccagtgttgttgtggacgaacaatcatggttatcttcaggcgtggaaaagtcgccctattaaacgtgattacgatcacattctcaagacgctacttacaaattacctacaagcttacaacattagcaggcgctgcatgtggcacctgttaatgataaaggcatataggatgttgtaactaatatggtgaaataagaaacccggtcgaaaccgggttcagaagtaacggtgttattagcacaacggacgtacagcttcgcgcatccctttttcgagaatcgcatccaggtcattagcaacctgctcgaccagaccaggcacttgcgtcaggtcctgctcccagtggtctttttctgccaaaacaatcgctaccagttcctgggtgccgataacacggtcacgatgctggctccagagttgctgataacgttccagccagtgtgcatcgtcctgtaccggatatgtttcgccgttacgctcaccacgatagaacgcaatcaatgccgctaatgcgaaagtaaggcgcgccggaagtgtgccgtttgccttctgccctgccagcagctgtggcaggatgcgggtgcggaacttggtcataccgttgagcgcgatagacagcagctgatgcttaatgtacgggttacggaaacgcccggtgactgcactggcgaaagattccagttcatcacgaggcaaatccagtaccggaataatttcttcgtagatagctttttcaacgaatgcgcaaatttcagcatcgttcatcgcttcacctacggtatccagccctgcctggaacgccaccggcaccagcgcggtgtgcgcaccgttgaggattgccactttgcgttctttgtacggtttaatatcgtcaacaatcagcacgttgagcggatatttgtccagacgcagttcagtcgctaaggatttcggtccctgaatcacaaacaggtaaaagtgttcagcggtgtcgagaaaaccatcgtgataacccagttcttcttccagtttagccacttcatcgcgcggataaccggtaacgatacggtccaccagcgtagaacagaagctgttagcctgatccagccattgaataaatgcttctggcagtgcccactcttgcgcatagcgcagcaccagttcacgcaacgcgtcgccattgtagtcaatcaactcacacggaatgatgatccaacctttatccagcgcaccgttgaaatggctaaagcgttcgaacagcagacgggtcagttttgccggatagcttaccgctggcgcgtcatcgaatttatcgcccgcatggtagctgatacccgcttcggtggtgttagagaaaacaaagcgcatttccgggttgtgcgccagtttcaggaattcatcgtattcactgtagacgctgatttcacgattaaccgagcgaatcagacgcgcgtcgctgaccgcttcccccttctcattcaggccacggataatggtggtgtacagaccatcctgcgtgctcagtgacggcgggaatgaagtttcaatcggacgaacaacgaccacgccagaattcagatcggtgtgctcattcaggagatcgatttgccagtcaacaaaggcgcgcaggaagttaccttcaccaaactgaatgatacgttctggatactgtgcaccgggaaaatcgcgacgatttagtgttttcacaatgggttcccttctgattagtcatacaacctgtttgaattggtacgacaggttagcaaactttaatacgccgaacccctgttttgatcaactcctgatgattaatgagcagttttatgagaaaagtgtggcgcggatcatggtttaatcgaggaaaaacgccttttcctggatcataaagtggtagaacacattgcattcaaatcgcgcgtaatgaataaagatgtcagacaacttcctcaccgtaacgcatagtgctggtacggttgcgcccatctttcttcgagcgatacagacacgtatcggcttcgaccatcaatttattaaagtcatcggtcagcgttaggtacgatgcgcgaccactaccgacgccaatacttaccgtgagataaagcgttttttgttgccaggtgaatggttgcagttcaacgcctttacggattttttccgccattagcagaccatcgacaggattcaccgacggcactgcaacagcaaattcttcgccgcccattcgcgccaccagccccttatcaccgacaatcttctgaatatgccgggcaaacacgcttaacactttatcgccacattcatgtccatagttatcgttaatgcttttgaaatagtcgatatcaagcagcatgacagtcagatgttgtgtctgtttcagcgatggacttttcagcgcctcataaagaccggaccgtgagtaaacctgagtcagaaaatcaaagtcggctcgcagcgcaacttgcttcattagcgaattgatcgctgccacgctaaaagaaaccataattgggcatatcgccatcgtggcaataccgagacgtgcggagaacatttgcggaatggagaacggcgaaccgaccgagatatcaatcaccgaatttgccaccagtacgatttccaccgcaccggtgacaaaggtcaacagacatgttacctgcggcgtatagcgcactgcacaccagattaatgcaggcagcgggaacgccagactccccgctccgccaatgactaccgaggcaataaccgacacaataagcgcgatggcgggcatcatctgttctgctttaaagcgcggcagcactccaggaatagccaacgtcagcatacaaggcacgatcaacacgcccgttgagaattgctcactgaaccagtccgcaagcaaaggccagaaatccagactatcaatactgaccgaaccaagatagcatgttcgctgacagcggcggcaaataaaggtaccctgggaatgctattttgtcgttttccgcaattctcatggctgattcatctgtacaaccagccagtgatagattaccgccacgatataacgttgttgttcttcgcttaacgaaacaccctgcggaatgttatgccacttagccagacaaccgcgacagcaggtcgcggtggcgtgctgagcgataaacaccggatgcccgcgcatgggggtttgcttaccgtcattagccggtaatgccggagcaagacgtttagcgacaaaatccgccgcatgttgttcgatgactggcgcgcctttctccaggcaatactgacgctctttcatgcccagacgaaagcgagagcgaaattttgaacgggataaacgcgcgaagagtggatcgagagactgcattaataaaccgaacgccctaactgtttcgtcaattgttcaagaacggcaatacccgcaagcgagttacctgcatcatccagttccggactccagacagcgatggccatttcatgcggaacaatcgccacaataccgccaccaacgccagatttcgccggtagccccacccgccaggcaaactcccccgcgttctggtacataccactggtcgccatcagcgcgttaatttgccgcgcctgcattggcgtcaccactggttcatcaatatgaatagctttcccctgattagccagaaagacaaacgtccgggccagctctacacagctcattttcagagcgcagtaatgaaagtagttttgcagaacggttgtcacgtcatgatggaaattgccaaacgacttcatcagccaggcgatagccgcatttcgcgcggaatgttcaaattcggaacgcgctaccaccgtatcgtaggaaatatcagacacaccgcttaagccgcgcacgacttccagcatacgttgccgtggtgcgcttaatcgcccttgcaacatatcgcagaccaccagcgcaccggcattaatgaacggattacgcggtataccctgctccatttccagttgcactaaggaattgaacggtgatccagacggatctttgccgacgcgttgccagatttcctcttcggagtaatgacgcatggcgacaacgagactcagcactttggaaatagactgaatggaaaaacgttcttgcgcgtctccggcctgaaaaagctgtccgtcaacggtacagatagcaatccccaatcgggaaccgtctactgtagccagcgccggaatataatccgcgactttaccctgaccaatgagcggccgcacttgccgcaagatgttttctaaaattgcattatccatggcgactgccactttctactcctggaccgcaggtctgaaaagacctgcgagtatatcagagctgaatatgtcgcgtcagatccggtctttccacaccgtctggatattacagaattcgtgtaagccgaaatgggaaagctcacgaccaaagccactctttttcacgccaccaaaggccactcgcgcgtcgctggcacaataaccattgataaacaccccaccgcattccagacgtgccgccatctgtctggcctgtgtttcgtcagtggtaaaaatggtcgctgaaaggccgaactcactatcattagccagttccagtgcatgttctgcatctttcgcaatggtgattgccgcaacggggccaaacatttcttcccgaaacgcggtcatttctggggtaacattcgccagaaccgttggcggatagtagttacctgccccagccatcttttccccgcccagtaacaaacgcgcaccctgcgccagggttttctccacctgatgatgcagctcatcacgtaaatcaaaacgagccattggtccgagagcgttctcttcgtcacggggatcgcccattttcaaggctgccgcagctgccacaaaacgttcggtaaatgccgaagcaattccctcttcgataataaagcgttttgccgctgcacatacctgtccggtattctgataacgtccggctaccgccgctttcaccgccagttccagatcggcatcgttaagcacaataaacggatccgaaccgcccagttccagtacgcattttttcagtgccgctccagcctgtgcgccaatagccgctcccgcacgaacacttccggtcaccgtgacagcagcaatgcgcgagtctttaatcatctgactgacaccgtcgttgtcggcattcagccagccatatacgccttgtgggatacccgcatctttaaacacctgggcaatgagctgtgcacagcccatcacattcggcgcatgtttaagtaagtagccgttacctgcaagaatgatgggaacagcgccacgcatcacctgccataacggaaaattccacggcataatcgccagaatcgtccccaacggtcgatactcaataaccgcctgctgattttccaccagcgtaggttccgccttcagcattgccggaccatgttctgcataccagtcacacaaattcgccgatttcgccacttcagcgcgcgcctggttgattggtttgcccatttcgcgggtgatcatttgcgccatttcttcgctacgagcgcgcagagccttaccgatatcacgcagtttttcagcacgataatctatatttgtctcgcgccagtcgcgaaagcctgctgccgccagctgaagtgcgttttcgatatcgtcagcgccagcccacggcagcacagaaagttgttcacccgtggcaggatttatcgaaattgcatgagttgccggagtaatggtcatcggggtatctcctttatgagtcatggtatgaagatacgcagatttactcttgctttaaaatgaataatattaagccacttattcacgaatcgagaatgctatggatctgacccaactggagatgttcaacgcggttgccgaagctggcagcataacccaggctgcagcaaaagtgcatcgcgtgccgtcgaatctcactacccgtctgcgccagctggaaacagaactgggggttgatctgtttattcgcgagaatcagcgtttacgtctctctcctgccgggcataactttttacgctatagccaacaaattctcgcgttagtggatgaagcgcggagcgttgtcgctggcgatgagccgcaaggtttattttctcttggttcgctggaaagcaccgctgcagtgcgcattccagccacgctggcggaattcaaccgtcgttatcccaaaattcagttttcactttccaccggcccttccggcactatgctggatggtgtactggagggaaaactgaatgcggcgtttattgatggacccattaaccatactgccatcgacgggataccggtataccgcgaggaactgatgatcgtcacgccacaaggatatgcgccagtaacccgtgccagtcaggttaatggcagtaacatttatgccttccgcgccaattgttcgtatcgtcgccacttcgagagctggtttcatgctgacggtgccgctccgggaactatccatgagatggagtcttatcacggaatgttggcctgtgtgatcgcaggagcaggcattgcgcttattccgcgctctatgctggaaagtatgccggggcatcaccaggttgaagcgtggccgttagctgagcaatggcgttggttaacaacctggctggtctggcgtcgtggtgcgaaaacacgtccgctcgaggcatttattcaactgctggatgtgcctgactcggcaagacagggatatcaatgagctatttttgatagttcttgcggttaatatgctctatatagtgatgttccgatgacttatgactatatggggcaaatatggttacgccagtaagcatcagcaattacatatctcttcctgatgattttcccgtacgtaatattgcaccgcaggtaaaagaagttttaaaggattttattgatgcacttagtacaataatatgtaatgaagagtggcgcacgtctttaaacatcaactcagccacaaaaaagatatttaataaccttgacaacttatcatatattcagaggacttcttttcggggtaacgacacgctatacaatgaaaaggttcagtttaaactcacttatcccgccaggaatggaagacacaaagaaaatattgaatttcaggtagtaataaatttaagccctatttatttagataattttcgccatgatggagaaattaatattttttgcgctcccaacccaaagcctgtcactatggggcgcgtatttcagaccggcgtcgagcgtgtactctttctgtttctgaatgattttattgaacaatttccaatgatcaaccctggtgttcccatcaaaagagcgcatacaccacatattgaacccctgccttcggatcaccataccgctgcagattacttacgccagtttgatttgcttgtcctgaattttatctctcgcggtaattttgtcatactcccccgattatggaataactctgaggttcacagatggttcgtcaataaagatcctaacttgatcaccgccattctcgacataacggacagcgaattaaaagaggatttgttgcaaagcctgatggattcattaggttctaacaaacatgtactacccgaagtctgcatctgctttttatcccttttagcagaacaagaatctcctcattttcagaacttgtttttatttttcgccaatatgttattgcactatcaccaatttatgaatcccaatgaaagtgatttgaatgacgtgttgatgccagcatcattaagtgatgataaaattatcaaacatatggcgcgcaggaccctcaaactgtttgtaaaaaatgaaacaccgccaaaagttactcacgaagacctggtgaaaaacaggcctcgctcccctgtcagaccacctatacccgcaaccgccaaaacgccagacctccctgaacgtcattaaaccgtgatgttaccgactctctgacgcgtgaaagaatcagcgtcagagaaacggaaaacgcgatccagatcacaaatgcattgtattcacatcattaaccgttttaagatcatttcatcactttttcgcaactcacccgataatctgttatgacaacaaacactgtttcccgcaaagtggcgtggctacgggtcgttacgctggcagtcgccgccttcatcttcaacaccaccgaatttgtccctgttggcctgctctctgacattgcgcaaagttttcacatgcaaaccgctcaggtcggcatcatgttgaccatttacgcatgggtagtagcgctaatgtcattgccttttatgttaatgaccagtcaggttgaacggcgcaaattactgatctgcctgtttgtggtgtttattgccagccacgtactgtcgtttttgtcgtggagctttaccgttctggtgatcagtcgcattggtgtggcttttgcacatgcgattttctggtcgattacggcgtctctggcgatccgtatggctccggccgggaagcgagcacaggcattgagtttaattgccaccggtacagcactggcgatggtcttaggtttacctctcgggcgcattgtgggccagtatttcggttggcgaatgaccttcttcgcgattggtattggggcgcttatcacccttttgtgcctgattaagttacttcccttactgcccagtgagcattccggttcactgaaaagcctcccgctattgttccgccgcccggcattgatgagcatttatttgttaactgtggtggttgtcaccgcccattacacggcatacagctatatcgagccttttgtacaaaacattgcgggattcagcgccaactttgccacggcattactgttattactcggtggtgcgggcattattggcagcgtgattttcggtaaactgggtaatcagtatgcgtctgcgttggtgagtacggcgattgcgctgttgctggtgtgcctggcattgctgttacctgcggcgaacagtgaaatacacctcggggtgctgagtattttctgggggatcgcgatgatgatcatcgggcttggtatgcaggttaaagtgctggcgctggcaccagatgctaccgacgtcgcgatggcgctattctccggcatatttaatattggaatcggggcgggtgcgttggtaggtaatcaggtgagtttgcactggtcaatgtcgatgattggttatgtgggcgcggtgcctgcttttgccgcgttaatttggtcaatcattatatttcgccgctggccagtgacactcgaagaacagacgcaatagttgaaaggcccattcgggccttttttaatggtacgttttaatgatttccaggatgccgttaataataaactgcacacccatacataccagcaggaatcccatcagacgggagatcgcttcaatgccacccttgcccaccagccgcataattgcgccggagctgcgtaggcttccccacaaaataaccgccaccaggaaaaagatcagcggcggcgcaaccatcagtacccaatcagcgaaggttgaactctgacgcactgtggacgccgagctaataatcatcgctatggttcccggaccggcagtacttggcattgccagcggcacaaaggcaatattggcactgggttcatcttccagctcttccgacttgcttttcgcctccggtgaatcaatcgctttctgttgcggaaagagcatccgaaaaccgataaacgcgacgattaagccgcctgcaattcgcagaccgggaatcgaaatgccaaatgtatccatcaccagttgcccggcgtaatacgccaccatcatgatggcaaatacgtacaccgaggccatcaacgactgacgattacgttcggcactgttcatgttgcctgccaggccaagaaataacgcgacagttgttaatgggttagctaacggcagcaacaccaccagccccaggccaattgctttaaacaaatctaacattggtggttgttatcctgtgtatctgggttatcagcgaaaagtataaggggtaaacaaggataaagtgtcactctttagctagccttgcatcgcattgaacaaaacttgaaccgatttagcaaaacgtggcatcggtcaattcattcatttgacttatacttgcctgggcaatattatcccctgcaactaattacttgccagggcaactaatgtgaaaagtaccagcgatctgttcaatgaaattattccattgggtcgcttaatccatatggttaatcagaagaaagatcgcctgcttaacgagtatctgtctccgctggatattaccgcggcacagtttaaggtgctctgctctatccgctgcgcggcgtgtattactccggttgaactgaaaaaggtattgtcggtcgacctgggagcactgacccgtatgctggatcgcctggtctgtaaaggctgggtggaaaggttgccgaacccgaatgacaagcgcggcgtactggtaaaacttaccaccggcggcgcggcaatatgtgaacaatgccatcaattagttggccaggacctgcaccaagaattaacaaaaaacctgacggcggacgaagtggcaacacttgagtatttgcttaagaaagtcctgccgtaaacaaaaaagaggtatgacgatgtccagacgcaatactgacgctattaccattcatagcattttggactggatcgaggacaacctggaatcgccactgtcactggagaaagtgtcagagcgttcgggttactccaaatggcacctgcaacggatgtttaaaaaagaaaccggtcattcattaggccaatacatccgcagccgtaagatgacggaaatcgcgcaaaagctgaaggaaagtaacgagccgatactctatctggcagaacgatatggcttcgagtcgcaacaaactctgacccgaaccttcaaaaattactttgatgttccgccgcataaataccggatgaccaatatgcagggcgaatcgcgctttttacatccattaaatcattacaacagctagttgaaaacgtgacaacgtcactgaggcaatcatgaaaccactttcatccgcaatagcagctgcgcttattctcttttccgcgcagggcgttgcggaacaaaccacgcagccagttgttacttcttgtgccaatgtcgtggttgttcccccatcgcaggaacacccaccgtttgatttaaatcacatgggtactggcagtgataagtcggatgcgctcggcgtgccctattataatcaacacgctatgtagtttgttctggccccgacatctcggggcttattaacttcccacctttaccgctttacgccaccgcaagccaaatacattgatatacagcccggtcataatgagcaccgcacctaaaaattgcagacccgttaagcgttcatccaacaatagtgccgcacttgccagtcctactacgggcaccagtaacgataacggtgcaacccgccaggtttcatagcgtcccagtaacgtcccccagatcccataaccaacaattgtcgccacaaacgccagatacatcagagacaagatggtggtcatatcgatagtaaccagactgtgaatcatggttgcggaaccatcgagaatcagcgaggcaacaaagaagggaatgattgggattaaagcgctccagattaccagcgacatcaccgccggacgcgttgagtgcgacatgatctttttattgaagatgttgccacacgcccaactaaatgctgccgccagggtcaacataaagccgagcatcgccacatgctgaccgttcagactatcttcgattaacaccagtacgccaaaaatcgctaaggcgatccccgccaattgtttgccatgcagtcgctccccgaaagtaaacgcgccaagcatgatagtaaaaaacgcctgtgcctgtaacaccagcgaagccagtccagcaggcataccgaagttaatggcacaaaaaagaaaagcaaactgcgcaaaactgatggttaatccataccccagcagcaaattcagtggtactttcggtcgtgcgacaaaaaagatagccggaaaagcgaccagcataaagcgcaaaccggccagcatcagcggtggcatgttatgaagccccactttgatgaccacaaaatttagcccccatacgaccactaccagtagcgccaacaccccatcttttcgcgacattctaccgcctctgaatttcatcttttgtaagcaatcaacttagctgaatttacttttctttaacagttgattcgttagtcgccggttacgacggcattaatgcgcaaataagtcgctatacttcggatttttgccatgctatttctttacatctctaaaacaaaacataacgaaacgcactgccggacagacaaatgaacttatccctacgacgctctaccagcgcccttcttgcctcgtcgttgttattaaccatcggacgcggcgctacgctgccatttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattactttagtgaataacgtgacgctggttgtgctcttttttgccctcattaactgcgcctattctgtttttgctaccgtgctgaaagcctggtttgccgacaatctttcgtccaccagcaaaacgaaaatcttctcaatcaactacaccatgctaaacattggctggaccatcggtccgccgctcggcacgctgttggtaatgcagagcatcaatctgcccttctggctggcagctatctgttccgcgtttcccatgcttttcattcaaatttgggtaaagcgcagcgagaaaatcatcgccacggaaacaggcagtgtctggtcgccgaaagttttattacaagataaagcactgttgtggtttacctgctctggttttctggcttcttttgtaagcggcgcatttgcttcatgcatttcacaatatgtgatggtgattgctgatggggattttgccgaaaaggtggtcgcggttgttcttccggtgaatgctgccatggtggttacgttgcaatattccgtgggccgccgacttaacccggctaacatccgcgcgctgatgacagcaggcaccctctgtttcgtcatcggtctggtcggttttattttttccggcaacagcctgctattgtggggtatgtcagctgcggtatttactgtcggtgaaatcatttatgcgccgggcgagtatatgttgattgaccatattgcgccgccagaaatgaaagccagctatttttccgcccagtctttaggctggcttggtgccgcgattaacccattagtgagtggcgtagtgctaaccagcctgccgccttcctcgctgtttgtcatcttagcgttggtgatcattgctgcgtgggtgctgatgttaaaagggattcgagcaagaccgtgggggcagcccgcgctttgttgatttaagtcgaacacaataaagatttaattcagccttcgtttaggttacctctgctaatatctttctcattgagatgaaaattaaggtaagcgaggaaacacaccacaccataaacggaggcaaataatgctgggtaatatgaatgtttttatggccgtactgggaataattttattttctggttttctggccgcgtatttcagccacaaatgggatgactaatgaacggagataatccctcacctaaccggccccttgttacagttgtgtacaaggggcctgatttttatgacggcgaaaaaaaaccgccagtaaaccggcggtgaatgcttgcatggatagatttgtgttttgcttttacgctaacaggcattttcctgcactgataacgaatcgttgacacagtagcatcagttttctcaatgaatgttaaacggagcttaaactcggttaatcacattttgttcgtcaataaacatgcagcgatttcttccggtttgcttaccctcatacattgcccggtccgctcttccaatgaccacatccagaggctcttcaggaaatgcgcgactcacacctgctgtcacggtaatgttgatatgcccttcagaatgtgtgatggcatggttatcgactaactggcaaattctgacacctgcacgacatgcttcttcatcattagccgctttgacaataatgataaattcttcgcccccgtagcgataaaccgtttcgtaatcacgcgtccaactggctaagtaagttgccagggtgcgtaatactacatcgccgattaaatgcccgtaggtatcattaaccaatttaaatcggtcaatatccaacaacattaaataaagattcagaggctcagcgttgcgtaactgatgatcaaaggattcatcaagaacccgacgacccggcaatcccgtcaaaacatccatattgctacggatcgtcagcaaataaattttgtaatcggttaatgccgcagtaaaagaaagcaacccctcctgaaaggcgtcgaaatgcgcgtcctgccagtgattttcaacaatagccagcattaattcccgaccacagttatgcatatgttgatgggcagaatccattagccgaacgtaaggtaattcatcgttatcgagtggccccagatgatcaatccaccgaccaaactggcacagtccataagaatggttatccgttatttctggcttactggcatctctcgcgaccacgctgtgaaacatactcaccagccactggtagtgggcatcgatagccttattgagatttaacaagatggcatcaatttccgttgtcttcttgatcattgccactcctttttcacagttccttgtgcgcgctattctaacgagagaaaagcaaaattacgtcaatattttcatagaaatccgaagttatgagtcatctctgagataacattgtgatttaaaacaaaatcagcggataaaaaagtgtttaattctgtaaattacctctgcattatcgtaaataaaaggatgacaaatagcataacccaataccctaatggcccagtagttcaggccatcaggctaatttatttttatttctgcaaatgagtgacccgaacgacggccggcgcgcttttcttatccagactgccactaatgttgatcatctggtccggctgaacttctcgtccatcaaagacggccgcaggaataacgacattaatttcaccgctcttatcgcgaaaaacgtaacggtcctctcctttgtgagaaatcaaattaccgcgtagtgaaaccgaagcgccatcgtgcatggtttttgcgaaatcaacggtcattttttttgcatcatcggttccgcgatagccatcttctattgcatgaggcggcggtggcgctgcatcctgttttaaaccgccctggtcatctgccaacgcataaggcatgacaagaaaacttgctaatacaatggcctgaaatttcatactaactccttaattgcgtttggtttgacttattaagtctggttgctatttttataattgccaaataagaatattgccaattgttataaggcatttaaaatcagccaactagctgtcaaatatacagagaatttaactcactaaagttaagaagattgaaaagtcttaaacatattttcagaataatcggatttatatgtttgaaaattattatattggacgagcatacagaaaaagcaaatcacctttacatataaaagcgtggacaaaaaacagtgaacattaatagagataaaattgtacaacttgtagataccgatactattgaaaacctgacatccgcgttgagtcaaagacttatcgcggatcaattacgcttaactaccgccgaatcatgcaccggcggtaagttggctagcgccctgtgtgcagctgaagatacacccaaattttacggtgcaggctttgttactttcaccgatcaggcaaagatgaaaatcctcagcgtaagccagcaatctcttgaacgatattctgcggtgagtgagaaagtggcagcagaaatggcaaccggtgccatagagcgtgcggatgctgatgtcagtattgccattaccggctacggcggaccggagggcggtgaagatggtacgccagcgggtaccgtctggtttgcgtggcatattaaaggccagaactacactgcggttatgcattttgctggcgactgcgaaacggtattagctttagcggtgaggtttgccctcgcccagctgctgcaattactgctataaccaggctggcctggcgatatctcaggccagccattggtggtgtttatatgttcaagccacgatgttgcagcatcggcataatcttaggtgccttaccgcgccattgtcgatacaggcgttccagatcttcgctgttacctctggaaaggatcgcctcgcgaaaacgcagcccattttcacgcgttaatccgccctgctcaacaaaccactgataaccatcatcggccaacatttgcgtccacagataagcgtaataacctgcagcatatccgccaccaaaaatatgggcgaaataactgctgcgatagcgtggcggtatagcaggaagatccatattttccgccaccagcgcccgcaattcaaaatcatcgacatcctgcattgcttcgttttcttccaggcaatgccagcgcatatcgagaagtgcggcgctaagcagttcgctcatctcataccctttgttgaacaggctggcattacgcattttctgttgcagttcgtcaggcattgctgccccgctctgataatgccgggcgtagcgagcgaatacctgcggatgcgttgcccagtgttcgttgatttgcgacggaaattcgacaaaatcacgcggcgtgttggtgccggaaagcgtggcataacgctggcgggcaaaaaggccgtgcagcgtatgaccaaattcatggaataaggttatgacatcatcccagagtaacaacgcaggctcaccggcagcgggtttctgataattgcagacgttataaattaccggatgtgttttattaagcgttgattgctcaacaaaattgcccatccatgcaccgccgctttttgaatcacgggcgaagaaatcaccgtaaaataacgccagccccacgccattatgatcaaaaatttcccacacacgaacgtcaggatggtagacaggaatatcaaaacgttcgacaaacttaataccgaagagctgattcgcggtccagaatacaccttcatttaacaccgtgtttaattcaaaatatggcttgagctgcgcctcatcaagatcaaatttctcccgccgtacctgttccgcataaaatgcccagtcccacggctgcgcgctaaacccgccctgctgcttatcgataaccgcctgtatggaggctaattcatcgctcgcacgttgacgcgccgctggaacaatttcccgcataaagttaagtgctgcttcaggtgtttttgccatctgatcggcgattttccatgcggcataatgaggaaaaccaagtagtgttgcctgttgtgcacggatctccaccagacgttgaatgatagcgcgggtatcattggcatcatttttttccgctcgcgtccagcccgcaataaacagtttttcacgcgtcgcacgatcgcgcatttcggcaagcgccggttgttgggtggtattcagcagcggaatcagccatttgttatccagacctttctcgcgagccgcctctgccgccagcgcaatctcttgctcactcattcctgccagctgcgcgatatcgttcacaaccagaccgccggatttatttgctgccagtaatcgctggttaaactggctggtcagggtcgcagcttctgtattcagtacttttaattttgctttatcagcttgcgcaagtttggctccggcaaggacaaaacgttgatgaatcacctccaccaggcggatggattcactatcaagccccagggattcacggcgctgccagacagcatctacccgcgcgaataattcaccgttcagatagatatcattagccagttccgccagttcagcggaaaactgctcgtcaagacgctgtaattcatcattggtatgcgccgcagtcatcgcaaaaaagacgctggtaacgcgggtaagtaattctccgctttgttccagtgccagaatagtattgttgaaatcaggcatttgcgggttaagcgcgatggcagcaatttctgcccgcttttgctgcattccctcatcgaatgccgggcgatagtgatgattggcaatttgatcaaaatggggagccagatacggcagtgtgctttgcacaaggaaaggattcattgttgtcattttcttctcctgaacgcgaggtgttccatagcgtaggcttactgataacggagtgcaatcttgcaatccagtattacccgctcttaagcatcccgtgctatgttattgacacacaaaagcgttgaggaacagtgagatgatcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaatttttatacccggcgtaactgccgggttattgcttgtcacaaaaaagtggtagactcatgcagttaactcactcacaagcaagaacgaatgaccgtcgaaacgcaacttaatcccacacagcctgtcaatcagcagatttatcgtattcttcgtcgcgacattgtccattgcctgattgctccaggcacaccgttgtcggaaaaagaagtttctgttcgtttcaatgtgtcacgccagccggttcgtgaagcctttattaaactggcggaaaacggcctgattcaaattcgtccgcaacgtggcagctacgtcaacaaaatttccatggcccaggtgcgcaacggcagttttatccgtcaggccattgagtgcgcggtggcgcgtcgggcggcgagcatgattaccgaaagccagtgctatcaactggaacaaaatcttcaccagcaacgcattgccattgagcgcaagcaactggatgatttttttgaacttgatgacaacttccatcaactcctgacgcagattgccgactgtcaactggcgtgggataccattgagaacctgaaagcgaccgttgatcgcgtgcgctatatgagtttcgaccacgtttctccaccagaaatgctgttacgccagcatcttgatattttctctgccctgcaaaaacgtgatggcgatgcggtagaacgtgcaatgacgcaacatttgcaggaaatcagcgaatccgtgcgccagatccgccaggaaaacagcgactggtttagcgaagagtaattcatttcctctcatcccatccggggtgagagtcttttcccccgccttatggctcatgcatgcatcaaaaaagatgtgagcttgatcaaaaacaaaaaatatttcactcgacaggagtatttatattgcgcccgttacgtgggcttcgactgtaaatcagaaaggagaaaacacctatgacgacctacgatcgtaaccgtaacgcaatcaccactggcagccgtgttatggttagcggcaccggtcacactggcaagatcctgtcgattgatactgaaggtctgaccgctgagcaaatccgccgcggaaaaaccgtagttgttgaaggttgtgaagagaaactggcaccactggacctgattcgtctcggcatgaactaagcgtgtgaatgccgccgatggcggcattgcttttttacttcacggaatattttgccacggtcgctttcgcgccatgcgctaataaagacaagtacgtttccgtcactcttgcagtaaacaaactattgtctggcaaatcatcaccaaagatcgccttaatcgccagcaatgactggacgcgcgctttcccttcggcactactttgtacagccttctgaataacaggtaacagtgggtcactgatttctatcggatttccctgttcatcaacaccaccgacataacgcatccaacccgcgacgcccagcgccagcagatcgaacttgctgtcatgcgccagatgccagcgaacagaatccaacatccgctgtggcaatttctggctaccatccatcgcaatctgccaggttcgatgacgtaacgccgggttgctatagcgtgcaattaatcggttagcgtaatcttgcaaatcaacgccctgcactttcaacgtcggcgcttgttcctgcaacatcaagccatacgccgcataacgataatgttcatcttccatacagtcattaatgtgctgatatcctgcaagataccccagatacgccaggaatgaatgactgccgttgagcatgcgcaacttcatctcttcataaggcagcacatcgctaaccagttcggctcccgctttttcccattccggacgtccggcaacaaagttatcttctattacccactggcggaaaggttcacaggcaacgcccgcaggatcgcgcacaccggtaagttgttcgattttcgccagcgtatcctctgtcactgcgggcacaatacggtccaccattgttgatgggaaagtcacgttatcttcgatccattgtgccagttttacatcaacggcttgtgcgtaggaagtgacaacgtcacgcataacatgaccgttttctggcatgttgtcacatgacatgacggtaaatgcgggaagtcctgccgctttacggcgagccagcgcctcaacaatcacccctgttgctgttttcggctggtggggattttgcacgtcggcagctaccatcgggtgatcgagcattaactgtccggtcgccggagagtggaaataccctttttcggtgattgtcagagagacaatcgcgatttgcggttcacacatcgctgccaacacggtttctaagccatctatctgtacgtgcaaggcttttttaacgacgccaacgacgcgagccgtccacacatcggccgacatttccgcaacggtataaagattatcttgctgttgtaaatcggcaatttgctgttcgccgccgattaagttgacctcataatatccccagtcactgaaatgttccgtagcaagaatatcggcatacacaccctgatgcgcacggtgaaatgcaccaaagcctaaatgaacaattcttggagccaggttattaagatcataaacagggagtgtcgcttttgctgataacaaattatttcccataacaattccttaaatataaatatggcaagctatatgttttgttatatgaataaaaatcccctctccggtaagagaagggattaagggtttacagacttctggaaggttgcgcagctcttacaacacgcggttgatcttccgcagcgtcttccagcgcacttaaatcacggtctttcacctctggcattttcagcgcagagattaaaccaatcactgaatatgccatgatcataatggcgatcggataccaggattccgtcatggtgcagaaaatacccgccaggataggaccaaaaccggaagcgataagaccaccaatttctttagaaatagccatccgggtaaagcggtttttacagccgaacatttctgccatggtaatgttttccagagcaaataatcccagcaccgcacagttatgaatcacaatcagtgcaaccataatggtgctcggggcatagcttttatctacaatgatagaaagcattggccatgccagcacaatcgcggaggtattcataataatatacgggatccggcgaccaattttatcggataaccaaccaaggaacggaatggtcataaagccgagaatcgaactgatcatcaatgcatctgttggaattgctttgttaaacaataacgtctgcactaaatagcctgcaaggaaagtctgaattaacccggagttacccgcctgaccaaaacgcagccctgttgccagccagaaggatttgctctggaacatgctaccagcaggtgcaggttttgctgtcggttggttactgtcgttaaccttctcaaagaccgggctttctttcagattcatacgcaaccagatagcaaagaccatcacgacaacactcgccaggaacggtatacgccatccccacgccagcagttcctctttactgagaatgaagaacataaaggcccagattgccgttgcgctcaaggttccgcagttagttcccatagccacaaatgaggagataattccgcgcttaccttttggcgcatattccgccagcatcgtaccggcaccggaaatttccgcacctgcacccaacccctgaataatacgcaacgtcaccagcaagatgggtgcaaaaacaccaatctgtgcataggtcggtaacacaccaattaaggtggtacagatccccatcatggtgatggtaataaagagcacttttttacgccctattctgtcgcccattttgccgaaaataaatgctccgacaatacgcgccacataacctgcaccgtaggttcccattgccagaattaacgccattgccgttgatgattcaggaaaaaatatttcatgaaacactaacgctgcgccgagcgaatataactggaaatccataattcacaggtgttttttcccatcctgtggtttccttggcgttttctaggttttttcagatagttgcatttttttaaaaagcatcctaagttcgatctcagtgtctatctggggcctatttctgtcccatatatgccccaaaaaaactccccaacagataagtagttttttcatggatttatgcgtaaaatcaagaacggctggaaatcattcaatactcacactatcgaaaaatttaccagccaatcgcagcacgttcttgcataaggtgtgtctgcggtttttcaactattcagatacatcactcccatcacattcattcctccgcatcaaaggcatataggctatatcaccttgatatttttctttttcagataaaaactgttatctatgtatacttttaaacccaatccgtgtagagtctctacataagatagtttgcagttgccgcttcagcttgcgccataaaccgcctgatttttgctgccacctgttagcattcctgtatacctgaaacgacaatgtttatctacgaactttaagaacacccaagataaaaattgtcaactatatcatatataacacattactaattcgaggctatatgaacagcatactgataatcacatctctccttatcatattcagcatttttagtcatgccctaataaaattagggattggcatatccaataacccagacaaaaccgatgtataagtcaacatatcctgaatcagacatacaatatcgcaatgaaaatcaataatattttaaggaatatcttcatgaaatcaaaagacaccctaaagtggttccctgcgcagcttcctgaagtaagaattatcctaggggatgctgtagtggaagtagcaaaacagggaagacctatcaataccagaacattgcttgattacattgaaggaaacataaagaaaaaatcatggctggataacaaagaattattacaaacagcgatatcagttcttaaagacaaccaaaatttaaatggtaaaatgtaatataataaacttacttttttatcatttttccactttaacaacattttgctccacttttccacgaccaaacaacttgaaatctggttaaaataacacgcaacactattcttcttccttgagtccgcccggaactcgaaaaacaaaccgagttaaagccatttttcacaaaatcgattttgggtctcaccaaaattacggggttgcatacgcattcgtttattttcgaacgtgtacatacaaatatgcacaaaaataatcataattattttctgagatgcattatgatatgaacaccaatttcgtatagagtctcactatgtctcaaatttttgcttactgtcggatatcaacgctggatcagaccaccgaaaatcaacgccgggaaatcgaaagtgcaggttttaaaatcaaacctcagcaaataatcgaagaacacattagcggctcagcagcaaccagtgagcgtcctggttttaaccggttgcttgctcgcctgaaatgtggtgatcaattgattgtgacaaaactggatcgccttggttgtaatgcaatggatatcaggaaaacagtggaacaactgaccgaaacaggtatcagagtgcattgcttagcattggggggcattgacctgaccagtccaacaggaaaaatgatgatgcaagtaatttcagcagtcgctgaatttgaacgagaccttttacttgaacgcactcattccgggatagtaagagcccgcggcgcagggaaacgttttggtcgaccacctgtgttaaatgaagaacagaaacaggcggtattcgaacgaattaagtcaggtgtaagtataagtgccattgcccgggaattcaaaacctcgcggcaaaccattttaagagccaaagcaaaacttcagacacctgacatataaaaaataatctcggtgtgagatgctttacgtcttccaagcccccttccttgccgtaaatggaaagatacatctaattatagaatttatatgttttaccctacggcagtgctggccattcaatatcctgtgcagttgacgtatcaacacggttcagcaatacccgatactttttccatgcttccagcaacgagatttcttcctccgttgcaatttccagatctgcagcatcctgaagcggcgcaatatgctcactggctacctgcatcaggttgttttttgtttcttccgcctcccggatccggaacagtttttctgcttccgtatccttcacccaggctgtgccgttccacttctgaaactccccttccggcgataaccaggtaacattttccggtaacggaccgagttcagaaataaataacgcgtcgccggaagccacgtcataaaccgttttaccccgatgatcttcaacgagatgccacgatgactcatcactgttgaaaacagccacgaagccagccggaatatctggcggtgcaatatcggtactgtttgctggcagacctgtatgaggcggaatatatgcatcaccttcaccaataaattcattagttccggccagcagattataaatttttatggtccgtggttgttcactcattctgaatgccattatgcaagcctcacaatatagttaaatgcgatgtttttgacggtgttttccgcgttaccagcagcgttaacggtgatggtgtgtccatgtgaaccaatcgcaacggagtgcgtatgagcaccaataccgacagtatgtgcatgcgcgcctgcgcttgcagcagtgccggacagcgagtgggtatgagcaccatctgatgatgtcttccctgcattacgagtctggccactaccgcttgttgtgctcataatccccgcgcttagatttgaaatcgcggtataaccattagggaaaatgctcgtgttcgtgccaccaaatgcaccggaactcttgtgttggtgcgcaccggcactatttgcggtcccgctaatactatgggtatgcgccccggtgttattcgtggatttggttccgtaatcaaacgacgatgtggtttccgtccccaaatccgtactggatgcgctggcgctgtgggtgtgcgatttaatgccgtcctgttcctgagataatacggcccgaccactggcgggcttgcccttaatcgtccagccacgcatatcagggatcacgcctgacggataagcaactgcaagtttcgggtatgcagatttgtcaaaagtctgcccctgcatcagggcataaccagacggaacggtatctgatggccacgggattggtgcaccgactggataaaactctgcaggaggatgagccgaggtgtaaagctgcgcccacggcgaccagtttgcgtcggtcgtatcccgtcgtgaacgaataaatgccggagcatgagcaccgcttgtaccactccagccgatgagtaactcaccttcgccaacggctgtcatccctttcaggtgaatgatatttccatacgctgttggatatccgttgttatacacctcgtataactcaagacctgctgccccctgcgtattgtctgtcagcgcggttatattcactcagcaaccccggtatcagttcatccagcgcggctgctttgttcatggctttgatgatatcccgtttcaggaaatcaacatgtcggttttccagttccggaaaacgccgctgcaccgacagggggatcccgtcgagaatactggcaatttcacctgcgatccgcgacagcacgaaagtacagaatgcggtttccaccacttcagcggagtctctggcatttttcagctcctgtgcgtcggcctgcgcacgcgtaagtcgatggcgttcgtactcaatagtccctggctggagatctgtctcgctggcctgccgcagttcttcaacttcccggcgcagcttttcgttctcaatttcagcatccctttcggcataccatcttataacggcggcagagtcataaagcacctcattacccttgccaccgcctcgcagaacgggcattccctgttcctgccagttctgaatggtacggatactcgcaccgaaaatgtcagccagctgctttttgttgacttccattgttcattccacggccaaaaacagagaaaggaaacgacagaggcccaaaagctcgttttcagcacctgtcgtttcctttcttttcagggggtattttaaataaaaacattaagttacgacgaagaagaacggaaatgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcaacgaagaacagaacccgcagaacaacaacccgcaacatccgctttcctaaccaaatgattgaacaaattaacatcgctcttgagcaaaaagggtccgggaatttctcagcctgggtcattgaagcctgccgccggagactgtgctcagaaaaaagagtttcttctgaagcaaacaaagaaaagagtgacattactgaattgctcagaaaacaggtcagaccagattgaagcaatttagataatcgtgcagactacgccccctcatatcacatggaaggtttatctatggatcaggtagtcatttttaaacaaatatttgataaagttcgaaacgatttaaactatcaatggttttattctgagctaaaacgtcacaatgtctcacattacatttactatttagccacagagaatgttcatattgtattaaaaaatgataatacagtgttattaaagggcctaaaaaacattgtgtctgtcaaattttcaaaggataggcatcttatagaaacgacctctaataagctgaaatccagagagatcacatttcaggaatacagaagaaaccttgctaaagcaggagtttttcggtgggttacaaatatccacgaacaaaaaagatattactatacctttgataattcattactatttactgaaagcatccagaaaactacacagatcttaccacgctaaaccataacgtccggcttctctcactcctgagccggactgcattggtttaataaaaaccatcaacaattgtgatttagatattcggaaccattcaaatataacaaaaccccgtaaaaacgaggtttatggataaattttattattgaatacatcagattaaattaatcttgacatcatagctttcaagacccgtcattttttcccgtgcggtaaactgaatactggtaacttctttcccggtctttttcttaagttcaataattttttttgttatatattcagaaatatctgcttctgcttttgtttttaagttttcaatattcatcatttcctcttttagtctgttatgactttccagttacacagtaagtcgattatatggtgcaaacgtgtaaaagataagatgaaacatcgcaataatcaacatacgatagtctaaattttacacaaacagacaaagagaattttcctgaattatcaatgcaatagcatcaaatcaactcaagagccttattgctgcttccagaatttcttctgaagtaacatgtcgatccgcggctacataaatgactttatgatctccggtcagagatggaaaccctgcggccattacagtaaggtgtgttttttcgccatttggatattcacgcatgatggtgttaactccagtcatcgctggcactaccactgctggttcagagttaaaaaaactatgatttttttcatgatgttaccgtagtatgtgagtatccatcgaatagacaccaagcaaaaaagctcccgaaggagccttcattttcacttttttaaatccaacgacagacggctggcatttaagtattgtgaaatattatcaaatgtaatcatcattgatttacaaaagatacattttgccccgaaaggattcatgtcagaaacatcaaaagatgatgttctatactgggaaccatgacaacacgggcatctaaagtgaatatggtttgtaatattgtctacctcaaagcgccactacatgaacagcggcaggacctttaggtccgttctcaataccaaattcaacttcctgattctcagttaatgttttgaaatcgttgctctgaattgctgagaaatggacaaacacatctttgctgccatctttcggcgtgatgaaaccaaaacctttttcagggttaaaccatttcactaaaccagtcattttgttagacataattattaccttttgaagaaattagcccttgggcagaatggtccgaaaaaaaatatcagagagaaaaaccaacaaggaaatctcaagaggtacaaataataaaattataacaatgactgcttcagataaatttgtaacaaaccagaacaccattaacgcatgattaaccacccatagcaaggattacttttgtaaagaaaaacacagcaatgaaagaatagctttatttattaataaaacgtgtcattctgattaagaccttttatcttacccttaagatttcaggaattttggctcatggaagagtcctttttatttaaattttacattccgcgatgtaaatgttccgatttaatattaccctacatttgatgctttttatctcttaaagattcatagatctgttgacaagtcactcctgcgatgtagcgttcgtcagcaatttcagcataaagctgagcttctgctgcaatatctccgagcatgttggtgagcattccttcggcggttttggttgttttgcctctgacggcagcggcaagatctgcggtatgcttcgctgcgtcaaggcgtatggcatatttttttgcttcggcacgcaactggttaacactatcagacagataagcagccctggcagaaatttcagcagatttctgttgcgcatctttaacagcctcatcacgggctatagttcgcccctgttcaattattcgagcagcaaattgagcatttacctcttgtgataatgcggcagcatcacgttccgcccattttttttgccatcctcggtcgctccagacatttccgacgataaatcctgacaacacgagaaaaatcaccatgaatatctgattcactgttctatcccccagcaggttaatgcgctctcctggtcacgacgaataacctgaccgtaacagttatttgaacgaatgcggcaatcgcgtccgccatccttaatccaccagcgaatcgcttcgcatgcacctttacgatcaccagcattcagccgcttataaaacgtcgacgggaaacacttaccggggccaatgttatagggacaaaatgacgcgatacccgctttttgtggttcggtcagtggtactttaatattgcgctccacccatgccagcgccttatcacgctcaatggcgttgacctggtcgcatttttccttcgacagtttcatattgggaaaaacggtttttccatccaccactgtggcaccccgacagatggtccatatgccagaaccatcgcggtatgccattgtgtggttaccttctttttcgtccagaaactggtcaagtatctgaggagcagatgcgccagcaccaatcagcgccagaacggcagccgacaggccgtatctgatttttgtgttcatagatatttatgatgaggacgctcgtgcttattggcaggattttcaatcttaaaggagtactgatgctgcagataagactcaactttttctgacaatttttctgctacttccaggaagacttgccggacgctccttctggctgctgcctcataaaactccagcgcagctccttcaacacggtccatggcgacatccaggtcaaaaatttcaccgtcaaagcgttctttgtcctgtaaggctacagttaccgtaactttattctcaaaattacggactcctttcacaaccagttcatagtcttgagtcattggattactctcctctcgcagccttacgcctgtcttctttaatcttgaaataaagatttgtcagatacgtcagcaggccaaaaaccaggctacccagcacaccgattgcagcccactgtgacggagttactttatcgagtaactgcaatgcccagaaaccagcattacccgccgatgtgccataggcaacacctgttgttaacttatccattgatttcatatcctcaccccgatgtacacggatggtgcaatatgtttgaaaagatcggagtctacggggtagttttgacagcacacgttgttctcaacggcgctaaaaaaacatacacattaaaaatgtgggtaattattttgaaagaaagtcatatataaaataataatacgagaaatgttttcatatttagtgtactgtatacggccatttatacaggaaaagcctatgtcagaacgtaaaaactcaaaatcacgccgtaattatctcgttaaatgttcctgcccaaactgcacccaagagtcagaacacagtttttcaagagtacaaaaaggtgcccttttgatctgccctcattgcaacaaagtattccagacaaatcttaaagctgtagcctgattgattttattagtaacaagtattttttatattttaataatatatttaaagcagataataaaaaacccgcctgagcgggtttgagattgtggtgctttttgtgggagtcatccacttacgcactttgttttgccatgccagcagttagcttctgctgtaaaactattcatgcagcaaacctgcacttcaccacaatggttagcatacttttcctgattaagattttgccaaatatgctagccattgtttcatgtattggacctccttactttttattaaagagatccaatattcactactctgtccgtatctctactcaggcatcagccttcttcgttatcgtatacagacgagcgatgaattttaatcagtaatgatgacatttgctgctgcaggacctttagcaccactctctatagagaaggtaaccttttgaccttcaaataaggttcgataattatcattctgaatcgcagaaaaatgcacaaacacatctttactaccatcaacaggagaaataaagccgaaacctttatcagcgttaaaccattttactaaaccagtcattttatttgacattctacattccttaacttgagcctttcggcataaatggtttgcataacagaaacgacttcgtacttaattggagagactcaaagaaggaataagtgaataacacctgaaatgagaactgctttagtaaactacttcgtatatcgtctgttcttcaaaccgacgcaatcattaacgcatagttgaacatatgaagcaatgtttattttagacatccagccatcttcaaccccatcaaaaaactatagctttcttcaggaacgtgtgtatagtgcgccaagttatcagtattaaggaatttttttgtcccgtaaaatgacaggaattgtcaaaacctttgacggcaaaagcggcaagggtcttatcaccccatccgatggtcgtatcgatgtccagcttcatgtttcagcgctcaatctccgcgatgcagaagaaattaccaccggattacgcgtggaattttgccggataaatggtctgcgtggcccttcagctgccaatgtttacctttcatgagctatattaaagctttaatttcaggccccatcggatcacacatggagagtttttatgaataaccccgtctgtcttgatgactggttgattggctttaaaagcttatgctgtactttggccgtaatagctctgctaataatataataagcagactcattgtgtttagggacattgtactggaagaaaacattttaaacatcaggcaaataaccaagtcaccagctaaataataagttaacagacatgagtcccgggatgagattcaacattaccattgccccatttaaagcacaaaacccgctcatcagcgggttttctactttttcttaacgtcgggtatacaaagcccatcgttgaaaaaattttatccatattttttgaaaaatgcaaacatcatgtcgccatcttcagcaaaaatcatttatctcgtcaccttcctcaattgcgcttccgcgtatgcttcttcctgccagcactttgttaccagtttaccaatgacgtccgcataccccttataccactgataatcggtcaggtctggtaccagcttctggacatgacgtcgtgccagcgtggtcggtaaacgactaaaccggtttccattacaacgcccacaaatcttatataccggtacgccatgaaaccgggttcttttttcatccagaacaatccctttacccttacaccctctgcacgctgtgctggcttcgcccttaccatggcaatgctgacatagttccttcacccattcttccttgattacagattccccgcgtctgtagtgtttcaccacttcgcgcaatacattataaaatcccgtacctgaacaatgctcacagcgagccttacttgccgcagacctggagtaatcagcaaaggcaaaactcacgaggtaaggaataatctgtaaccggatttcttcactcaatttgttcaatgtcgggttatccagtgccatcgcgtaatttagcaggccttcaatcgcaaactgagggtcctgaacaccaacttttgccagaaataaggccaacccaagtggtgctttcgactgcaccatcccctgcgctgccattacatccgtaattgttaaacaaccggtgcctgtcgctggagcgtcatcgctcaattttggagattttggggagtaatattttggtaaggcttcaaggttcatgctcgttctccacttacgccagtacgccaattgccagcgcgcgatcgataaaacgaaatatcagctccagttgggagccatacttatcttcaaatgccactgtatccgtatgcagctcgttgtgatgctttctgcacaaaggcaacacaaagagatcatgtgcttttgttcccattccgccctgcccgtgaccaatcagatgatgcggatcgtcggctggcataccgcagcaagcacacggctgtgtcttaacccaacgtgtgtatttctccttaacccagcggcgacgtttaggcagcttcatgaaagattccggagactctggatcaacggtgatgcttaccaccgtcttttcctgtggtgatttttgttgctggtgggcgtaaggcaacggtgcaagattttttgtgcgttgtttcaatatgctggtggcggtcagctctcccggtacgatgtcgctttcgcggtacaccgagcagattttttccgctggtaatcccagcgaacgacgcgatacagcctcaggtagtgcatccaccacctgattgcagaccgcccaccaggataattcagccaaagataattcccgctcctgcgtaccgcttattgcgtgacggatgacgtcaatcacccatgctgtcagattttgttgagcaagcagctccagtgattccgatgtctggtcacgcagttggttgtcgcagtgccagcacaacaccattgcgccggtaccataacggtgaatgactgtttcagtgtgatggtaatcgccattaggccactggcaggatgtaacatgacgtaatagccagtcggacaatgcgccaacgccgccagcagcacgaatcacccgttcgttactaaaaaacggcagcaatgttttgtcttccgccagcggctggcgaacggcaggaacgactccggatggcagattacgcatgctttttggttccggttccaccagcactcgaggattatgaaatatctgtatggattcacggcccggcttaaggaccaccagcccaagctcaggcaccagaacaggtctaagtaatacccgcacgttacctccagatccgttgctggaaagtgcgggacgcacgtggtgggcgttcggaataaggcagcctgacagagattatccagtgccgatagtcgagactgagagctttcttaacctcgaacccgcgcctgcggtaagaatgaatcagccattcggcctgttctgcagtgcatggagggtgctggaaccattcagacttgaatgcgtgagaataccgcccgtgcgtgcaggcaagaacgggcgaattatcagaattgtaatattttgcgttgcgtgccatcggttttctccggtggcacggtgttactcagcgggagttcagccccgcgcaagattgtagatgagtttattctcctgaaaaagcagaaaagccagcttttattccgatctctttcaatgcctgtaatgaagtgacaaactcaccttcgcgcaagataaatccgtccgtgacccgagcatccacaaaattaattaacgcagccccattctttcgcaaacacataatgcggtaatgactaacaagatttccattttcaacgcacacagcatagaggccatcttcacaaaaaattttacgcagttcttcgatgttcatcatcagaatccttccggataattagctctcccctttaagggaccatccctcttatccctgcgcgctacttaagtatttttgattctattccggcaccgtccagaacttcaaacgcgttgaaaataaaaacaaaaacccgccgaagcgggttaagtgcgggtgcgttgaggatgcctgccacatcagaggtggcgagggatttctcccccgccgggtctcttactcctcaggttcgtaagctgtgaagacagcgacctccgtctggccggttcggattcgtacctcgcagaggtctttcctcgttaccagtgccgtcactatgacggttaaacagatgacgatcagggcgattaacatcgccttttgctgcttcatagcctgcttctcctgtcaacgcaaagcagaagtgtcaccttcggtgcgaaacagagatgtcatgctttggttcagagaatgcgtttgaccgcctcgctatatacttccgagcgttctcttttcccaacagaaatcacgaaaacgacaactttctcgtctataacctggtatacaaggcgatagcctgaagaccggagcttaatcttgtaacaatcaggcataccacggagcttgtttgcttcaatccggggtgactcaagtacttcaaccagcttctttttcaactgttcacgtaccgtcgagcccagctttcgccattcctttagtgcccgctcgtcaaaatccagaaaatacgccatcagagttcatccagcgtcacacgtactggcttaggattacgaagccgttctttcactatctccacaagttcagcatcttcatcactcaggagtgtctgtttgaacggcaagcgttcattgtcagcgatatactcgagcatgagacgaagcgcttcagaaggagttacacccattttttcaagcgcggcgtaagaacgcgctttaagttcatcgtcaatacgcaggttaatgctacccatgtcttacacctcttgtaattacaaatgtcattacaagtatcgcactacaacatgcttagggcaagtcacgaaggaagtcagaaagtagtcgtaagaacggtgatcactgtccgctttgtgccaggagcagccattgctaagtccatcctgtattgtgcaggtcagctcgtttttaaagagtccggccatcatcttactggtacagacaccatatactttgtgacggtcaggctacatatgcacaactcaacttattcatctattttttgctttagcatgtcagtgttgctttctcgtcggcgggtgagcggtgacctgacctgtcgataaaggaacgtaacacgttttatgcaacacccgcatgcggcagaaaattattgccgaacgtttacccctgtcaacaagctttactttctgaggcgcgccagcccgcgaggaaaacaatctgaacatcaaacaattaatgacacaagaaatacgattaaagatttttttgtgcatgccgatagtgcttttttaaaaggagaaatctatgtctgtcacaattcagggaaatacctcaaccgttatttcaaacaactccgccccggaaggaacatcagaaatagccaaaatcacaagacaaattcaggtgctgactgaaaagcttgggaaaatctcatcggaagaggggatgacgacacagcagaaaaaagaaatggctgcattggtacagaagcaaattgaaagcctctgggctcaactggagcagttgttaaggcagcaggcagagaaaaagaatgaagacgcgacagttcagcctgataaaaaagaagagaaaaaagacgatacaaataccgctggcaccattgatatttacgtctaagtgacagccgtattgtggccctcatcgggccacttttcgccatcagccttttctttaaagacatattatctttgtatcatttctgatagttaacattacaagatataagtaatggacgcactcccaattagtctatttaaatcgccacgagtttaactgacaacccatgatcaattatgaattgcaactatttctgtagtcacttttgtggggacagtccacaaaactgccaacttccgcttcttgctcttagcggacattagcataggctatttaccataacgcctcattacgcgcaccgcccagactgactcagcgcgtttctggcatatccccggtaaaacaagtaacaaaccacccgaaaatgaacaccagaaacgcgacttaagaatctaccctatgaatggatatgcactcaaccgaatcgatcttggtttcaatcttttttatcgggatcaggcttctttttaggtaacttcgggggcttaacttgctgatgactttgcgttcggcgcgtaagccagggatggtcagctttaggtttaacatagtattttgagcgtaaatcaatacgggcattatccactcgttcatggacactcttttcatcatccagtggtagcctccataattgcaggcactagcgccgtgaacttttcacgcttatccctggtgtcgatagccttccagcgttcaaatatcttcactcgattaacgccaagcgctcgctgatcaatcgcgccaccttcatatgtgacacgctgaacatcgatgttcgggcgctctttcaaagcccagaatgcttcagtgattaatatcgtcgcctgctcctgtgtcattcctggtcgacatatccaggcatccagagcctcacgagcctgttcaggagtgattttcattgttcaaccgccccgcccgcttcgtcttacgatattcatcataaactttgggatcatactgaagctccccgccagatgcctcctgtagacgcatcgcgcgaccttcgggaactaaatcccctttccagctataaagcgaagccaaacgaatacctgctgcttgtgcaagttttgtttttgaaccgaaatacaaaagagcgtcagttttaagcatttaaaacacctttattgttagtcataactaacaagatagatgttaacaaaaacatagtcaatacgatttagcattagctaactatggaaacaaaaaatttaactatcggcgaacgcatcaggtatcgtcggaaaaacctcaaacacacccaaaggtctcttgctaaagccctgaaaatctcccatgtgtctgtatcacaatgggaacggggtgatagtgaacctacagggaagaacctttttgccctcagtaaagtattgcaatgctcaccaacatggattctatttggcgatgaagacaagcaaccaacaccacctgttgagaagccagttgccttatcccccaaagaactagagctccttgagctgtttaatgcactgccagaatcagaacaggatacccagctcgccgaaatgcgagctcgagtaaaaaacttcaataaactctttgaagaattactaaaagcccgtcagcggacaaataaaagataacatcatcaatgagttatcttttaccacatcaattatgttagctatagcatacaaaatcacttgaccgatatgttagtcatggctaatcttgtttgcatcaacacaccgcacggtgttctcagcaaacagttccgctaccccagcgttaaggggaaatgaggtcagcatggatactatcgatcttggcaacaacgaatctctggtgtacggcgtgtttccaaaccaggacggcacgttcaccgcaatgacgtataccaaaagcaaaacgtttaaaaccgaaaatggtgcccgtcgctggctggaaagaaactcaggtgagtgatatggatttcgacacaatcatggaaaaggcttacgaagaatacttcgaaggccttgccgaaggcgaagaagctctcagcttcagtgagtttaaacaggcgctttccagttcggcaaaatctaacggctgataagcgaaacagcaccgcgaggaatcagtatgcagaaacgagaacccgtcatcatcgcgccagactataccgatgatgaactttatgagtggatgcgccagaaaattaatgcagcgcaggatctgaaatgggctaatgaagccagggctaagcaggctgaaaatctgtccgctctggagcaggatatcaccaatctggaaaaagcagcggcattaagcattgccagaatgattacatacccgcgttagtagctaatcaacaaagctaaggttagtaattaaggagttctccacgggtgaggtggagtgcgtgcgccggacacgggtgcgcatccggaactgacagtttactgaaaggatatttccctgaaaagtcagaccataacgcgaaagcgcatggcgaggtagctggttcatagatagcctgtcgttaaattttcgtcgaccgtgcgcttccggttgtggcaacccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcaggagtgtatgactgcagcaaccgaacagaaaattcccggtaactgttacccggtcgataaagttattcaccaggataatatcgaaatcccggcaggtctttaaaacagttccgtaataaatatccggtttcattcttatatgccagcaatggcagggatttgttcatccttaaatctgtcatgaggttaaaacaaatgagtaaagtctttatttgcgccgctattcctgacgaactggcaacaagggaagaaggcgctgtggctgtagccacagccattgaagctggcgacgaacgccgtgctcgagcaaaatttcactggcaattcctggaacattatccggctgctcaggactgcgcttataaatttattgtctgcgaggataaacctggcataccccgccctgccctcgattcatgggatgctgaatatatgcaggaaaaccgctgggatgaggagtctgcttcttttgtcccggttgagactgaatccgatccgatgaacgtcacttttgacaagctggcccctgaagtacagaacgctgtcatggttaagttcgacacatgtgaaaacatcaccgttgatatggttattagcgcacaggaattgttgcaggaagacatggcaacattcgacggacatatcgttgaagcgttgatgaaaatgccagaagttaacgccatgtatccggagcttaagttgcacgccattgggtgggttaagcataaatgtattcctggtgctaaatggcccgaaattcaggcagagatgcgcatctggaaaaaacgtcgcgaaggtgaacgcaaggaaaccggaaaatacacgtctgttgttgatctcgcccgcgccagagccaatcaacagtacactgaaaattcaacaggaaaaatcagcccggtcattgctgccattcatcgcgaatacaagcagacatggaaaacactggatgacgaactggcctatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccacaggtgaactacgctcctctgtttgttacgcaataaaaactggtgttttcgactatgcaaaacagtttccctcctcacgcaatctggaaaaatttggtgaggcccgacaagatttaaccataaaagaactggctgaaaaatttctggcactgaaagaaactgaagtcgccaaaacatcactcaacacataccgtgccgtcatcaaaaatatcctgagcataatcggtgaaaaaaatcttgcctcatcgattaataaagaaaaattactggaggttcgtaaagagttactgactggataccagatccccaaaagtaactatattgttacacaaccagggagatcggctgtaactgtaaataattacatgacaaatcttaacgccgtgttccagtttggtgttgataacggttacctggcagataatccgtttaaggggatctcgccattaaaggaatcaagaaccattccggatcctctttcgcgggaagaatttatccgtcttatcgatgcgtgcagaaatcagcaagcaaaaaatttatggtgtgtttctgtttatactggagttcgccctggtgagctgtgtgcacttggatgggaggacatagatctgaaaaatggaacaatgatgatcaggagaaatttagcaaaagaccgtttcacggtaccaaaaacacaggcgggaaccaatcgggtcattcatcttattaagccagcaatcgacgctctccggagtcagatgacattaacgagactgagcaaagagcatatcattgatgttcacttcagagagtatggcagaacagaaaaacaaaaatgcacctttgtttttcaacctgaagtgtcagcgagagtaaaaaattatggtgaccattttaccgttgactcaataaggcagatgtgggacgcagcgataaaacgtgccggactccgccatcgaaaatcatatcagtcgagacatacttatgcctgctggtcgctgacagctggtgctaacccggcatttatagcaaaccagatgggccatgcagatgcgcaaatggtatttcaggtatacggaaaatggatgtctgaaaacaataatgcacaggtagctttgttaaatacacagttaagcgagtttgccccaaccatgccccataacgaagcaatgaaaaattaatttaatatttatcaaatagttaacacgcatgactcttgaaatccataaattcaagcgcagtgcccagccatcccgatactgctgctttcaccaaatccttagtgcttctttcgtgtttttctattgtcataatggttatctctaaaaaagaggtaagatgcgtactacttactcgccgttattggtattattcagaaaaagtgagtaagactttgcagcaatgtttttgatcctgttcaaataaactaatggcatcagcaacatgctggaaatcaaacgtatgggtaattaatttttctggtttaattaaccctttacttaaccagtcgataacgatcgggaatttatttgcatttaagcgtgaagagaaaatagagagttcttttccggtaattccttgctgaatcacttcagacggttcactggagaaccccatcaatacaatacgtgccgctggagaagccagcgttacggcctctttcaggatagaaggatgacaagccgcatcgataattaatgtcggcttgatgcctttttcagtgaaaatctcgccaagcggtgtctggctgttattaatcgcccagtcagccccgctctctttcgctttttccagtcgttcatcaatgcgatcggcaacaatcacatttttaacgttatagacgccttttaatacctgaacgatcgtcaggccgattggaccggcaccataaaccagaacggtatcattttcagtcggttgaccatgtccggttacgttagccgcaatggtaaaaggttcgatcattaccgcatattgatcggccactgcttcaggaattttccacgcattttttgccggaaccacggcatattcactgaaaccaccgtcagcgtgcacacctaatacagccagtgtcgtacaaacgttcggtttacctatagagcacggatagcaatgcccacagctgaccaccggatcgacagcaacacgttcaccgactctggcgctttccacgccttcacccactgcatcaatgacgccaaagaattcatgaccaatgacgcgcggatatttcgcaaaaggattatgcccacgataaatatggctatctgaaccacaaattccggcaagtttcacttttactcgtacttcacccgctgacggggtgggtatttcacgttcgacaatcgccagttgattcggtttttcaattaatatgcttttcattatcttactccttaccagttccacagcgtgccatcttccagacgtgcgactggtagataagcaggttcatagggatatttcgccgccagcttttcatcgaattcgataccaagacccggtttgtctcccggatgcatatagccgttatcgaaagtccagttgtgcgggaagacttcgagcatttgttcggaataacccatgtattcctggacaccgaaattggggacccacagatcaaagtgcagcgccgcagccatgcagactggtgacaaatcggaaggaccgtgtgagccagtacgtacctgatacagcgaagcaaaatcggcaatccggcgcataccggtaattccgcctgcatgggtcagcgtggtgcggatataatcgatgagttgctcttcaatcagttgtttgcagtcccagatgctgttgaagacttcacccactgcgatgggtgtgacggtatgttggcgaatgagacggaagcattcctggttttccgcaggcgtcgggtcttccatccagaacatgcgataatcttcaatgcttttaccaaagcgcgccgcttcaataggcgttaagcgatggtgcatgtcatgcagcaaatgttcattaaaaccaaacttgttacgtaccgcgtcaaacaatttcggcatgaaatcgaggtatttctccgtcgaccacagctgctcttccggccactgtcctttggttgcgggttcataagccagacctttacctttcgacatgccgtaggtggttttcataccagggattccgcactgcacgcggatggctttgaatccaagctcttgatgacgggcataatcatccagagcttcatcaatactgtgaccggtggtatggcaataaaccatcaccccttcacgagacgcgccgccgagtaactggtaaagcggcatgttggcagctttggctttaatatcccacagcgccatatcaaccgctgaaatggccgacatcgtaaccggaccgcgacgccagtaagcacctttatagaaaaactgccagatatcttcgatacggtgcgcatcgcgaccaataagctgcggacaaaggtgatcctgcaaataagaggccacggaaagctcacgtccattgagggtggcatccccaaggcccgtaataccgtcctcagtggtgatttttaatgtgacgaaattacgccccggacaggtaacaaaaacttcagcctttacgatcttcatgttcgattccttgcatcgcttgtcgtgatgcatgaaatctacgcaactgagctactaccatacaagtataaagatcgaaaaaagccggagtgatcacaaaaaaaggcgtatatttgcgctgtgaatggttgacaaaagatgaaatagaataccttttgtcagctgacacttcctcttatcttattgataaaatggatttatgttcctacgtgcgcccccagcccgcaacaatgatcaacatgccgcaaagcgcaatcaacgcacccgtccagtcataaagagtcagtttcacgccatccacaacgcgcagccacatcaacgccgtgcagacataaacgccaccataagccgcgtaaacacgcccactcgccgctggatgcaacgttaacaaccagacaaacagcgccagtgaaatccccgccggaagcaacagccagatactggcgtttcgttttaaccacaaccagggcagaaagcatccaataatttcacacagcgcagtagcaaaaaatagtaacgttgttttaatcatctttgtctcttattgacatcatgtatagttatagggcgacataatatcatcaatataaacaccctcctggtacgttttgcgtccgcagtggatggtgtagaatcacctttaatcattcatacagggaatgaattatgaaaatcactctcagcaaacgaatcggcctgctcgctattctgctgccttgcgcactggcattgagcacaactgttcatgccgaaactaacaaactggtgattgagtctggcgacagtgcacaaagccgccagcacgccgctatggaaaaagagcaatggaatgacacgcgcaatctgcgccagaaagtgaataaacgcactgaaaaagagtgggataaagccgacgccgcttttgataaccgcgataaatgtgagcaaagcgccaacatcaatgcctactgggagcccaatactttgcgctgcctggaccgtcgaactggccgcgttattaccccctaacctgttattgatttaaggaatgtaaggacacgttatgccaagcgcccacagtgttaagctacgcccgctggagcgtgaagatttacgctatgtacatcaactcgacaataacgccagtgtgatgcgttactggtttgaggaaccctacgaagcctttgttgaactctctgatctgtatgataagcatattcacgatcagagcgaacggcgctttgtggtggaatgtgacggcgaaaaagccggtctggtggagctggtggaaattaaccatgttcatcgccgcgcagaatttcagataattatctccccggagtatcaggggaaaggtctggcaacccgtgccgccaaattagcaatggactatggctttaccgttctcaatctctataagctgtatctgatcgttgataaagagaatgaaaaagcgattcacatttaccgcaagcttggcttttcggttgaaggtgaattgatgcacgagttctttattaatggtcaatatcgtaatgccattcgcatgtgtatattccagcatcagtatctggcagagcacaaaacaccgggtcagactctcctgaagccgaccgcacaatagcattaataataatcgatcgtatttttgatggtgtaaacccgttcgacggcgggttttactccttcatcaacaatgattagctgacagtccaccggattagcgtgactgtcatattcacagctctgttttacattaccaacccgttgattattcagtaaagtaaccgctgtgtaatctaattttttgatcggatccgttgatggcgtggcgctgacagataatgttttgtcgttacttttcgtggttttacccagcggataaccctgatcatcatagcgatattccatctgcatttgtttgctgctggctttaatcacgaagccattatcatcggtttcccaactcaccccggcagaaggtaattctgctagctggcattttccctgtaaacgtactctcttctccagcgtctcggcatcacggtaataattggcgtccagtaccagagcgaccacggtattattttccagatccagtaattcgagtgaatcaaaacagccttcttccgacaaagtcccagaaacacgtttcgtcacttcaccttgctcatccattaatgtctgagtgaaatcttttaccggaccacgcagcggatcaaaatcgaattcattagagaaactggccatctcaggggtaaatgaaagtgttacctctgtgcggtcacatcctgtgaggaatatcgcgagtaagcatggtagtaatttgtatttcacaacagtcaccagagagtagagatgattctcaatcatagtagcaaatacagtactttacacgttaaatgctatgcttaaagaagttatcttcgcgtaaggagcttatgatgaaactctcaacctgctgtgccgcgcttctgctcgccctcgcctcacccgcggtactcgccgcgccgggatcctgtgagcgcatacagagcgatatatcacagcgcattatcaataatggcgtacccgaaagcagcttcacgttaagtattgtacccaatgaccaggttgatcagcctgattcccaggtcgtcggccattgcgctaatgatacgcataaaattctctatacccgcaccaccagcggtaacgtctctgctcccgcgcagtctagccaggatggcgcgcctgccgaaccgcagtaacacattatcgactgaacgccggatatgacaaatccggcgatttgaacatacaacataatcccaccttattactcatacccttctattgatatggattaataattcttaacccaaaatgggtagactccctctattgttagcgcgctaaatattcaatatataaacttttatataacgataaagaacagggagtgagttatgtccaaaaatgaacgaatggtgggcatcagccgcagaacactcgttaaatctaccgcgataggttctctggcgctggctgcaggcggtttttctttgccgtttaccctgcgcaatgcagcagcagcggtacaacaggcccgcgaaaaagtggtctggggtgcctgttccgtcaactgtggtagccgctgtgcacttcgtctacatgttaaagataatgaagtgacctgggtggaaactgacaataccggcagcgatgagtacggcaaccatcaggtacgcgcctgtttgcgcggtcgctccatccgccggcgtattaatcatcccgatcgcttgaattacccaatgaaacgcgtgggcaaacgcggcgaaggcaaattcgaacggattagctgggatgaagccctggatactatcgccagtagcctgaagaaaaccgtcgaacaatatggcaatgaggctgtatatattcagtactcttcggggatcgttggcggcaatatgacccgctcttcgccatcagcctcggcggtcaaacgcctgatgaactgctacggcggttcactcaaccagtatggctcctacagcactgcgcaaatttcctgtgccatgccctacacctacggcagtaatgatggcaacagcaccacggatattgaaaacagcaagctggtcgtgatgtttggtaacaacccggcagaaacccgcatgagcggtggtggcatcacttatcttcttgaaaaagcgcgcgagaaatcgaacgccaaaatgattgttatcgatccgcgatataccgatacggctgccggtcgtgaagacgaatggctccctattcgcccgggcaccgatgccgcgctggttgcgggtattgcctgggtattgattaacgaaaatctcgttgatcaaccttttctcgataaatactgcgtcggctatgacgaaaaaaccttacccgcagatgcacccaaaaatggtcactataaagcctatattcttggtgaaggtgacgataaaacagcgaaaacgccgcagtgggcttcgcaaattaccggtatcccggaggaccgtatcatcaaactggcgcgtgaaattggcacagcaaaacccgcttatatctgccagggctgggggccacaacgccaggcaaacggcgaactgactgcacgcgctattgctatgttacctattttgacgggcaatgtcggcatcagcggcggaaatagtggcgcgcgtgaatcgacctataccattaccatagaacgcctgccggtgctggataatccggtcaaaacgtcaatctcctgcttcagctggacagatgctatcgatcatggtccgcaaatgacggcaatccgcgacggcgtccgcggcaaagataaactggatgtgcccattaagttcatctggaactacgcgggaaataccctcgttaatcagcattctgacatcaacaaaacgcatgaaattctgcaggacgaatcgaaatgcgaaatgattgtggtcatcgaaaactttatgacctcatcggcaaaatatgccgacattctgctgccagacctgatgaccgttgagcaggaagatattattcctaacgactacgccggtaacatgggatatctcattttcctccagcctgtcaccagcgaaaaattcgaacgcaaaccgatttactggatcctgagtgaagtcgcgaaacgtcttggacctgacgtctatcaaaagttcacagaaggtcgcacgcaggaacaatggttacaacatctgtacgccaaaatgcttgccaaagatccggcgttaccgtcttacgacgaactgaaaaaaatgggtatctataagcgtaaagatcccaatggccattttgtcgcctacaaagcatttcgtgacgaccccgaggcaaatccacttaaaacgccttccggtaagattgaaatttattccagcaggctggcggaaattgcccgtacctgggaactggaaaaagatgaagtgataagcccattgccagtttatgcctcaacctttgaaggctggaactcccctgaacgtagaaccttcccactgcaactgtttggtttccattacaaatcccgtactcactcgacctacggcaatattgatctcctgaaggctgcctgccgtcaggaggtgtggatcaaccctatagatgcgcagaaacgtgggattgccaacggcgatatggtgcgggtgtttaaccatcgtggcgaagttcggctaccagccaaagtaacaccacgtattctccctggagttagcgctatgggccagggagcctggcacgaggccaatatgtctggcgataaaatcgaccatggcggctgtgtgaatacgctaaccactctgcgcccttcaccactggcgaagggaaacccgcagcacactaatctggtcgagatcgaaaaaatataacccacgacaaccataaattctggcatgacattttgtttgaaaagcaataagtgagtaatgatgaaaatccataccacagaggcgctcatgaaggctgaaatcagccgtagaagtctgatgaaaacctccgcacttggcagtcttgcgctggcaagcagtgctttcactctgccattttcccaaatggtccgggcggcagaggctccggtagaagagaaagcggtctggagttcctgcaccgttaactgcgggagccgctgtctgttacgtttgcatgtgaaagatgacaccgtgtactgggtggagtctgatacgacaggtgacgacgtctacggtaatcatcaggttcgagcgtgtttacgcgggcgctctatccgccgacggatgaatcatcctgataggttgaaatatcccatgaagcgcgtcggcaagcgcggtgaaggtaaatttgaacggataagttgggacgaagccctggataccatcagtgataatcttcggcggatcctgaaagattacggcaatgaggctgtacatgtcctgtacggaacaggcgtagatggcggaaacatcaccaactcaaacgtcccgtaccgtctgatgaactcttgcggtggttttctcagtcgctatggcagctacagtaccgcacagatcagtgccgcaatgagttatatgttcggtgccaatgatggcaacagcccggatgatatcgccaatacgaaactggtcgttatgttcggaaataacccggcagaaacgcggatgagcggcggtggtgtcacttactacgtcgagcaagcccgcgaacgttcaaacgcacgcatgatcgtcatcgatccacgttataacgacactgctgccgggcgtgaagatgaatggctgcccattcgccctggcaccgatggcgcactggcctgtgcgattgcctgggtactgattactgaaaacatggtcgatcagccatttctcgacaaatattgtgttggttacgatgaaaaaacgctgcccgccaacgcaccacgtaacgcgcattataaagcctatattctgggcgaagggcctgacggcatagctaaaacgccggaatgggcagcaaaaatcaccagcatcccggcagaaaaaattatccagttggcacgagagatcggttcagcaaaacctgcttatatttgtcagggttgggggccacaacgacattccaacggcgagcaaacatcccgcgctattgccatgctttccgttctcaccggcaacgtcggcataaacggcggcaactcaggcgtacgcgaaggtagctgggatctgggggtagaatggttcccgatgctcgagaatcctgttaaaacgcagatttccgtctttacatggacagatgccatcgaccatggtacggaaatgaccgcgacccgtgatggtgttcgtggaaaagaaaaactggatgtccccatcaagtttttatggtgctacgccagtaacacattgatcaatcaacatggcgacatcaatcacacccatgaggtgcttcaggatgacagcaagtgcgagatgattgttggcattgaccacttcatgacggcctcggctaagtattgcgatatcctgttgcccgacctgatgccaacagagcaagaagaccttatctctcatgaatctgcagggaatatgggctatgtgatcctcgcccaacccgcaacctcagcaaaatttgaacgcaaacccatctactggatgctgagtgaagtcgccaaacgcttaggaccagacgtttatcaaacctttactgaaggtcgcagtcagcatgaatggatcaaatatctccatgcgaaaacgaaggaacgtaaccctgagatgcccgactacgaggagatgaaaacgaccgggatctttaagaaaaaatgcccggaagaacactacgtcgctttccgcgcattccgtgaagatccacaggcaaacccgttgaaaacaccttcggggaaaatcgaaatttattctgaacgactggcgaagattgcagatacctgggaattgaaaaaagatgaaattattcatccccttcctgcgtataccccaggttttgatggctgggacgatcccctgcggaaaacctatccactgcagttaacgggcttccattacaaagcgcgtacccactccagctacggcaatattgatgtgttacagcaggcctgcccacaagaggtgtggatcaaccccattgatgctcaggcacgcggtatccgtcatggcgataccgtgcgggtatttaacaataatggagaaatgctgattgccgcaaaagtgactccgcgtattctgcctggcgttaccgccatcgggcaaggtgcgtggcttaaagcggatatgtttggtgaccgggtcgatcacggcggcagtatcaatattctgacctctcaccgcccttcaccgctggcaaagggaaacccgtcgcacagcaatcttgtccagatcgaaaaggtttaaggagtagcccatgaccacacaatatggattttttatcgattccagccgctgtactggctgtaaaacctgcgaactggcgtgcaaagattttaaagatcttggcccggaagtcagtttccgccgtatttatgaatacgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaaaatgggaaatggatggcatgagtggccactggttatctttaccgtattgggtcaatgcgtagtaggcgcgctgattgttagcggaattggctggttcgccgccaaaaatgacgcagaccgtcagcgtattgtccgtggcatgtttttcctctggctgttgatgggcgtcgggtttattgcctctgtcatgcacctgggatcgccactgcgggcgtttaactccctgaatcgaatcggagcttctggtctgagtaacgagattgctgccggttccatattttttgccgttggcggattatggtggctggtggcagtcatcggtaaaatgccgcaagcgttggggaaactctggttacttttcagcatggcgctcggcgtcattttcgtctggatgatgacctgcgtgtatcaaatcgacaccgtgccaacctggcataacggttacactacgctggctttcttcctgacggtattgttgagcggtccaatacttgctgccgcaattctgcgggcagctcgcgttacatttaataccacaccatttgccatcattagcgttctggcgctgatcgcttgtgccggggtgattgtgctgcaaggtttgtctctggcgtctattcactcatccgtgcaacaagccagcgcactggtaccagattacgcctccttacaggtctggcgtgtggtattgttatgcgcaggtcttggatgctggctttgcccgctcattcgtcgccgtgaacctcacgttgccggacttattctggggctaatcctcatacttggcggtgagatgatcgggcgtgtgctcttttatggcctgcacatgacagtaggaatggctattgcaggttaacaaattggtgcggggcaacccgcacatttcaggatgttaggaatgacccatttttcacagcaagataatttttctgtcgcggcgcgcgtgttgggcgcgctgttttattacgctccagagagtgcggaagccgcacctctggttgcggtactcaccagtgacggctgggaaactcagtggcctctaccagaagcgtcattagcgccgctggtgacggcttttcagacacagtgtgaagagactcacgcccaggcctggcagcgtttgtttgtcggcccgtgggcactgccgtctccgccgtgggggtcggtctggctggatcgcgaatctgtgctgtttggcgattcaacattggcacttcgtcagtggatgcgcgagaaaggcattcagtttgaaatgaagcaaaacgaaccggaagatcattttggttcactgctgttgatggctgcgtggttggcggagaatggtcgccagacagaatgcgaagaattgctggcatggcacctttttccgtggtcaacacgttttcttgatgtttttatcgaaaaagcagaacaccctttctaccgtgcactgggtgaactggctcgcttaacgctggcgcaatggcaatcacaactgttaattcctgtcgcggttaaaccgctgtttcgataggatcaccgtaatattgccggatggtgacgattacgcgcaatccggcaataataggttacagtgtcacgtttttttatctcttaaagcacgcactgcttttgcggctggcctcttttgccgcaaaatagtcgcccgtgtttcattgcccatttctgctcatgcatcatctacacatctatccggatctgcgcactatgttccaccgtctgcttatcgcaacagtcgtcggtattctcgcggcctttgccgttgccgggtttcgtcatgcgatgctgctactggagtggttgttcctcaataatgactccggcagtctggtcaatgcagcgacaaacctttccccctggcgacggttgctaactccggcgctcggcggactggcggcgggtttgttgctgatgggctggcagaaatttacccaacaacgccctcatgcgccgaccgattatatggaagcgttgcaaaccgatggacagttcgattacgcagcaagcctggttaaatcgcttgcctctctgctggtagtaaccagcggcagtgcaattggtcgcgaaggtgcgatgattcttttagctgcccttgccgcctcctgttttgcccaacgttttacgccacgccaggagtggaaattatggatcgcctgtggggccgcggcgggaatggctgcggcctatcgtgccccgcttgctggcagtttatttatagccgaagtgctgtttggcactatgatgttggcctctctcggcccggtgattatttccgccgtcgtggcattgctggttagcaatctgattaatcatagcgacgcgttactctacaacgtacaactctcagtgacggttcaggctcgtgactatgcgctgattatcagtacaggtgtgctggcaggtctgtgcggaccactgttgttaacgttaatgaacgcctgtcatcgtggatttgtgagtctcaaacttgcgccgccctggcaactggcactaggcgggttgatcgtgggtctgctttccctgttcacacctgcagtgtggggcaacggctatagcaccgtacaatcctttttaaccgccccaccactgttaatgatcattgccgggatcttcctttgtaaactgtgtgccgtgctggcgagtagcggttccggcgcacccggtggggtctttacaccgacgctatttatcggtcttgccattggcatgttgtatggtcgtagcctgggattatggttccctgatggcgaagaaattacacttttactcggattgaccgggatggcgacactgttggcggcgaccacgcacgcgccgattatgtcgacgttgatgatatgtgaaatgaccggggagtatcagctactccccggtttattgattgcctgcgtaattgcgtcggtaatttcgcggacgttacaccgtgactctatctaccgccagcacactgcgcagcatagctaagcggatgtattgccccagttcacgctgttcggcgcgcggcagataaggcagttcaccaatgagcggtgccggaagttttttacccagcacatcaatgatttccgcataatgcgccagtcctgggttgattcggttagccacccagccaatgagcggcagcccgtcgttggcgatcgcctgagctgttagcagtgcatggttaatgcaaccttcctgaataccgacaaccatcaacaccggcagttgttcctgcactacccattcagagagtggacgcaaatcattcatcagactgcgccagccgccagtcccttctaccacgacatgatcgactttttcggtcaggtttgccaggccgtttgaaatgagggtgtaattgattgggcaactgtgcgccacgctactttcttcttcgcttaacgcgataggattaactgcttcataaggcagttcgatggttgaaacactctgcaacaccagggcatctttattacgcagcccttcgggtgtctctttgctccccttcgctacgggtttatatcccgcaaccgtttttccctgggaggctaacgcttgtagcaatgcgcgggaaaccaccgttttccctacagaagtgtctgtaccggtaataaagaaacgcttcagcatcactaactccaccgttatgcttcacaaatataaaccaggaaaataattaaccttgaaagtctaagttatgctttcctggcccaaattgagatagcgcaaattttggtagaacagttaaaaaatgttaaccctgcaacagacgaatcaacaaagaaccgttatacatcgcgtcttttaccagtgcagcgcctgccatcgtgccctggttagaaaactgagtactctcaacgctgatgtgctgactatacgcaggaagggcctgctgacggatgctgtctgagatgaccgggaagaggatatctgccgctttacttaacggtgagccaatcagtattttttgtgggttaaataaattcaccatgatggcaagaatgcgcccgacatgcgcgcccaccccggtaatgatgtcttttgccagtagatcgccgcgcaatgccgcctgacacaatgagtccacggttaacggttgtccatgtaacatcgagctcatggattgattaagacgcagctgtgccagctcaagaatactgtccacgctggcgatggtttcgaggcagccgtgattcccgcaataacagcgtttcccatacgggtcgacctgtgtgtggcctatttccacgagactactgctgcctgcgtgtagcagatgaccatcggtaatgacgcccgcccccacgttgtgatcgataaccacctgaatcacatcgcgcgccccgcgtgaggcaccaaacaaggcctctgccatcgtccatgcgctgatatcatgctgaatataaaccggaacgccggtatgctgctccagcgcctcgccgagcggcatctcttttacatcctcgtagaacggcatgcgatgtacaataccattttccgtatcaataattcccggcaaggttatggcaatcgaagttagacgctcaagttttttctggtggcggataaaaaactgatcgatatgggaaataatacgatccagcaatggcaagtcatcttttaacgccagttcctgcgactcttccaccaccagtttgctgctcagatcgcgcagagcaaggaaaatctccccgcgactaatgcgcagagaaagatagtgccaggcttcagtttcaaccaccagccccaccgccggacggccacggttccccgcttctttgatttccagctcttgcaccaggtgtgcttcgagcatctcacggacaattttagtgatactggcaggagccagttgcgccagacgggaaagatcgatacgcgagactggaccaagctgatcaatcaggcgataaaccgcgcccgcgttggtctgctttatttgatcaatgtgcccaggctggttttcagcaaccaccgcatactccctatattttcgcgctccgaaataatctgtaggctatggtgaagcacttcaatacgtgtcgtcaaatttttacttaggcatgtgattaacagcacatttttcgggctttttcgctgaaatttccctcacctgagagcattcagcagatgaatacgaaagttacgcgcagccggactttgttcatgatgtttcggccagaccaaccacatttcagaaaccgcatcctcttcagcaatcggcacccagcgcatttcgttgagctgaacacgtttaaatgacgcaggcaaaattgaaacacccagaccggcggaaaccagaccgatgatggtcattgcctcgcccacctcctgagtgatgacgggcgtcaaatggtaacgtcgcatcagcccgagaatatcgtcatacagccctgtcccgacgtgcggatcaaaaaagacaaagggttctttcgccagttcagccagcgttacattcgggttatttgccaggggatgatcgtgcgggatcatcgccataagcggttcatggacgatgactgcgtgttcaagcgactccggtaacgctgtgttacgcagcaatcccatatccagcgttccttcaatgagcggagcgatttgctcgcgagtgttcatttcgcgggtttgtaaatggacatcaggataatcacggcgaaacagcgataacgtatcggacaccgcccgaataaaaggagccgacgaagtaaaaccaatgcgcaactcccccgcttcaccctgatgcagcctttcagcgcgagcggcagcgtcatccaccatagacaggatttgccgactatctgcaagaaactgttttcctgctgccgtcagcaatacactgcgattggttcgtgccagcagtcgggcaccaatttgttgctccagcgcctgaatctgctgacttagcggcggttgcgaaatattcaggcgggcagcggcgcgcccgaaatgcagctcttccgcaacagcaacaaagtaacgcagatgacgaagttcaatattcatatttaaaacatcttatttgagattattaatatattagacagaacaattcgattttcctaccctatgtataagcctgatctacaggcatatttagcaaggatttcaagtgagccgtactacaactgttgatggcgctccggcaagcgacactgacaagcaaagcatttctcagccaaatcaatttattaaacgcggtacgccgcaatttatgcgcgtcaccctggcgctgttctctgccggactggcaacatttgcacttctctattgtgtgcagcctatccttccggtgctttcgcaggagtttggcttaacccccgcgaacagtagtatttcactgtccatttccacggcgatgttggctattggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagctgttggcatgacttatcttagcgaggaaatccatcccagtttcgtggccttttcaatggggttgtatatcagcggcaactcaattggcggcatgagcggacgcttaattagcggtgtcttcacggactttttcaactggcgaattgctctggcggcaatcggttgtttcgcgctggcctcggcgttgatgttctggaaaatcctccctgaatcacgccattttcgcccgacttcgctgcgccctaagacgttgtttatcaactttcgtctgcactggcgtgaccggggattaccgttattgttcgcagaaggctttttgctgatggggtcgttcgtcacgctgtttaattacatcggctatcggttgatgctctccccctggcatgtcagtcaggccgtggttggcttattatcgctggcttatttgaccggtacatggagctcacccaaagccggaaccatgaccacccgctatgggcgtggtccagtgatgttgttttcgacgggggttatgctgtttggtttactgatgaccttattcagctcgctgtggctgatctttgccggaatgttactcttctcagcaggattcttcgcagcccactcagtagccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcgtcgtctgcacgcctgaaaaataagtccggactgcggtaaatacccgtccggacttattgccagctcaaaccaacgttaatagccatcctaaaatagacgaagcgccagccaattcccgcagcgcgtctagcgtcatcaggattataagtacccaaataaacggattcattttgctgtgtgtcatttattactgatgcgcagttattctactgctttgtaagtagtaaaatagttaacccgatcaagactactattattggtagctaaatttcccttaagtcacaatacgttattatcaacgctgtaatttattcagcgtttgtacatatcgttacacgctgaaaccaaccactcacggaagtctgccattcccagggatatagttatttcaacggccccgcagtggggttaaatgaaaaaacaaattgagggtatgacaatgaaaaaagtattagctctggttgttgccgctgctatgggtctgtcttctgccgcctttgctgcagagactacgaccacacctgctccgactgcgacgaccaccaaagcagcgccggcgaaaactacacatcataaaaaacagcataaagcagcacctgcccagaaagcgcaggcggctaaaaagcatcataaaaatacgaaagctgaacagaaagcccctgaacaaaaagcgcaggcagcgaagaaacacgccaagaaacacagccatcagcaaccggcaaaacctgctgcacaacccgcagcgtaagttttcaacagtaatgctggcgcgccccctcgcgcctgaaaattacggtgctaagcgggtaacgtttagcaccgcctttagcggagggtagtatggtgggccgttatcgctttgagttcattctgatcatccttattttatgcgcactgattaccgcccgtttttatctttcctgattgtagttatctgattttactcccactttcatcccgtcccgtctatagtatttatgagggtttgcttttaataatcataattacccaccagagtgtgatatgcgtacaaccattgctgtagtgttgggtgcaattagtttgacgtctgcttttgtgtttgcagataaaccagacgttgccagatcggcaaacgatgaggtcagcaccctgttttttggtcatgatgatcgtgtgccagtgaatgacacgacccaatcaccgtgggatgcggttgggcaactggaaacggccagcggcaatttatgtacggcgacgctgattgcacccaatctggcattaacggcaggacactgtttattgacacctccaaagggtaaagccgataaagcagtggcgctgcgttttgtgtcaaataaaggtctttggcgctatgagatccacgacatagaaggccgcgttgatccgacactgggaaagcggttaaaagcagatggggatggttggattgtacctcccgcagccgcgccgtgggacttcggattgattgtgctacgtaatcccccttctggcattacgccgttgccgttatttgagggagataaagccgcgcttaccgccgcattaaaagcggcaggtcgtaaagtgactcaggcaggctaccctgaagatcatctcgatacgttgtacagtcatcaaaactgtgaagtgactggctgggcgcaaacgtcggtgatgtcacatcagtgcgataccttgccgggtgacagcggttcgcctctgatgttgcataccgatgacggctggcaattaattggggtgcaaagttcggctcctgccgcgaaagatcgctggcgcgccgataaccgggccatttctgttaccggttttcgcgacaagctggatcaactgtcgcaaaaataatgttcaaacgctgcccgacagcgcgggcagcgtcttcatcaggcaagtttcaccatgatcattccagccaacagcaagaccaggccaatccagcctttacgatttaaccgttgaccaaacaagatccaacctgcggctaacgtggcggcaataccaaacccgccccacaatgcataagcgacagacaagtcgatccctttaacggcttgagaaagcgcactaaaggcagccagcaccgccgccagggagagcaagccaaatattttgcgacgaaagccgtcagaaaatttcaaaaagacgttagcaacgatttccagcacgattgccaatgccagccaggcggcgtgaacccattcaaactgcgccatggttcacctccagttcaggtttacgcgctttacgggtacctgattttatcaacacaatcccggcgaccagggtggttaacccggcaattttcatcagcgataaactttcgtcgaataacaaaacgctaaacaaggtaataaataaaataccgataccttcccacagcgcataagctacgcctaaggcgatttttttaacggcgaaagagagaaatatatacgacagagaaatcatcaccagcattaaaataaagccgccatttccctcactgacgctcgcccatttcattgacagcgtaccggtaatttctgtagcaatagccagacctaataaaatccaataaatatacattgtccttctcctgcaagagaattattttaattttcgcttaattcagcgaaaccaaagtaaagtggtcaagccccgcgcatagcgcaagctttggcagaagaaaggactaaagcgcgttgcgccagtgctgctcacctacgagcaagatagtggatgaggtacgaagatgggtaaatgtagaaaataacgtcctgaacaaattgtccataatattacaattatccgcagtgttgcttctcgtcatcgcggatgataattgtcctcggtagttgaacacgcctgatttgtatcatagcttaagaattaactcaaaatattttcacttctttacctgagcggtttgattttcgttatgatgacggagcgaaaaagacattattattagcaaaggaagaaaaaacggggacaagcatggcaaagccgatcatcacgctcaatggcctaaaaatcgtcattatgttgggaatgctggtcattattctctgcggtatccgttttgccgccgagatcatcgtgccgtttattctcgcattatttattgctgttattcttaacccgctggtgcaacacatggtccgctggcgtgtgccgcgtgtactggcggtgtcgattttgatgaccatcatcgtgatggcgatggtgttgctattagcttatctgggttccgcgctcaacgagttgacgcggacgttaccgcaatatcgcaactctattatgacgccgctgcaagcgcttgaaccgttgttgcaacgcgtagggattgacgtctcagttgaccagctggcgcattatattgatccgaacgcggcgatgacgttgctcaccaacttattgacgcagttatctaatgccatgtcatcaatatttttattgctgctgacggtgctgtttatgctgctcgaagtgccacaattgcccggaaaatttcagcaaatgatggcgcgtccggttgaagggatggcggcgattcaacgtgcgattgacagtgtttctcattatctggtgctgaaaacagccatcagcatcatcaccggcctggtcgcctgggcgatgctcgccgcactcgatgttcgcttcgcttttgtctggggattgctggcctttgcgcttaattacatcccgaatattggttcagtcctcgcggcaatcccccctatcgctcaggtactggtgtttaatggcttctacgaagcgttgctggtgctggcgggatatctgctgattaatctggtcttcggcaatattctggagccgcgtatcatggggcgtgggctggggctttccacattggtggtatttttgtcgttgattttttggggatggttgttaggaccggtgggtatgctgctttccgtgccgttgacaattattgtcaaaattgcgcttgaacaaacagcgggaggtcaaagcatcgccgttctgttaagcgatctcaataaagagtgacggcctcagcagaggccgtcagggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcgaccgggtggataccgaaacgcacattaataccacgagcgcgcaatttctcagtaatttcagcgacaggatattgcgcctgcgcgactgccatgccgtaccccggagtaatgatcactgaatgggagtttttcagcagttccgctgtctcttctgcggtgatttcgcggtgctcacccacttcctgatcatcgccagtagaagagccgtcggtgccgaaaccacccgcaataacgctgataaaggaacggttcatcgccttacacataatgtaagaaaggatagcccccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaattgcggtcattatcagcaatgccagcacttgcaggccgacgctgtccgtgcgaacaaatacaatcagcagcaggaaggaaacgaccagagccgccaggttcattttgtgacggtttggcagcatcaatggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgccagacggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaaaacggtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatattgccgtctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgccagcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtaatttgcccggtaaagaagcgcccaaattcatgtgccgcttcaacaatggcgcgataaccggcgatgttcgccatcgagcttagtgcgtccagcgattgtgcgcgtgagatacgcggcacagagtccatcgccatcacggtcacgttacgttccgcaagtttttgcattaattccggattctgcgcaggccagataaaactcaccagcgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattcgcatgatattcccttccatcggttttattgatgatggtttgcctgtgtcaggagccacacaagctgctcatgtacgagctaaatgttactccgttaaaataaattagtaacaaacgccctataacgtactgaaaattatgcctgtgatctagcgccaaaaatcagtatttcggcgtgaactcgcaaaatattaacgattcagccgtgatagtgggataaacaccttagaacgccggataaagactgataattgtcttcgacggtcgggtaaaacgagacatcgccccggcacgaatcactacttaacattaaattaacttatacaattcagttgcttcagtagtaatgatgctgatacggctgttttttaagcatagacggtcatttgagcaggattaaaattggcttaaggaatgtgatatgaaaaatgacgcagacagttacaccgtttaaatgcaataatcagccacgtttctcgttaataacaataccagtacctggtttgcgcaaggcgaaggattatttttatgaagcttaagaacaccctcctggcgtcggcactgctttctgctatggcattctccgttaacgcagcaacagaactgacaccggagcaagcggcagcggttaaaccttttgaccgtgtagtggttaccggtcgttttaatgctattggcgaagcggtgaaagccgtttctcgtcgcgcagataaagaaggtgccgcctctttttatgttgtcgacacttctgattttggtaacagcggtaactggcgtgtggtcgctgacctctataaagccgatgctgaaaaagcagaagaaacaagtaatcgcgtaattaacggtgttgtcgaactgccgaaagatcaggctgttctgattgaaccgtttgacacggtcaccgtccagggcttctatcgtagccagccagaagtcaatgatgccatcaccaaagcggcaaaagcgaaaggtgcctactctttctacatcgttcgtcaaatcgatgccaaccagggcggcaaccagcgtattactgcattcatctataaaaaagatgctaagaaacgtatcgtccagagcccggatgtgatcccggcagattccgaagcaggacgtgcagctctggctgccggtggcgaagccgcgaagaaagttgagatcccgggtgttgcgactaccgcatcaccaagttctgaagtcggtcgcttctttgaaacccagtcatcaaaaggcgggcgttacaccgtcacgctcccggatggcactaaagtcgaagaactgaacaaagcgaccgcagcgatgatggtcccgttcgacagcatcaaattctctggcaactacggcaacatgaccgaagtctcctatcaggttgcgaaacgtgccgcgaagaaaggtgctaagtattaccacatcacccgccagtggcaggaacgtggtaataacctgaccgtcagcgcagatctgtataaataactattcagttactcctataaggcggcttgatgccgcctttcgcatttttagtcacaaatttccccgcgaccattgcatgcagacacatctcttcgtaaaatcccgcgcttcagtggcaaactccatttttatgcgttttgccctaatatttattcttcttatcacgttttaatcactggatatcgatggaaaagaaactgggactgagcgcactcaccgcgctggtattaagctcaatgctgggcgcgggtgttttcagtctgccgcaaaatatggcggcagttgccagcccggcagcactgctcatcggctggggtattactggcgctggcattttattgctggcctttgccatgctgatcctcacgcgcattcgtcccgaacttgacggcggtatctttacctatgcccgcgaagggtttggcgagctaatcggcttttgttccgcatggggatactggctgtgcgcagtcatcgccaacgtctcctatctggtgatcgttttttccgcgttaagcttttttacggacacgccggaattgcgcctgtttggcgatggtaatacctggcaatcgatagtcggtgcatcggctttattgtggattgttcactttttgatcctgcgcggggtgcaaaccgctgccagcattaacctggtggcgacactggcaaaattgttgccgctgggtctgtttgttgtgctggcgatgatgatgttcaaactggataccttcaagctcgacttcaccggacttgcacttggcgtacccgtttgggaacaggtgaaaaacaccatgctgatcaccctgtgggttttcattggtgtggaaggtgccgtggttgtttctgcgcgtgcgcgtaataaacgtgatgttggcaaagcgacactgctggcggttctctccgctctgggcgtttacttgctggtaacgctgctttcgctgggtgtggtggcacgtcctgaactggctgaaattcgtaacccgtcaatggccggtctgatggtggaaatgatgggaccatggggcgaaatcatcatcgctgccggtttgatcgtttccgtttgcggcgcgtacttaagctggaccatcatggcagcagaagtaccgttcctggccgccactcataaagcattcccgcgcatttttgcgcgccagaacgcacaagctgcgccatccgcctcactgtggttgaccaacatctgcgtgcaaatttgtctggtactcatctggctgaccggttccgattacaacacgttgctgaccatcgcctcagaaatgattctggtgccctatttcctggtcggcgcgttcttgctgaaaatcgcaacccgtccactgcataaagcggtaggtgtcggtgcctgcatttatggcttatggttattgtacgcctctggtccaatgcacttgctgttatccgttgttctgtatgcaccggggctgctggttttcctgtacgcgcgcaaaacgcatacccatgataatgtactgaaccgtcaggaaatggtgctgattggcatgctgttaattgcctcagttccggcgacctggatgctggtgggataacgttcatcccatcgttggatagcaaaggagataacgatgggtaaaacccagcccttgccaatattaattactggcggaggtcgtcgcatcggcctcgccctcgcatggcatttcattaatcaaaagcaaccggtgattgtcagctatcggacacactatccagccattgatggactgattaatgcaggtgcgcagtgtattcaggctgatttttcgaccaacgacggtgtgatggcgtttgccgatgaagtactaaaaagcacccatggtctgcgtgctattttgcataacgccagtgcgtggatggcggaaaaaccgggtgcgccactggccgacgtactggcttgcatgatgcagatccacgttaataccccatacctgctcaaccatgcgctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgccgaatatcgacaacaggcgctgaataaatcactgatgaaaaccgcgcctggcgagaaagaagtgatcgacctggtcgattacttacttaccagttgctttgtcaccggacgcagtttcccacttgatggcggtcgtcatctgcgttaatgcagctttatccagcatataatcaacacccatgcgcttatcccccaacacgcaacagaaccaacaaaagcggcgggcaagcgcatcattccggtgaaataccacagcgacaccaggtaaacaaaatagggaataatcgaccacatactaaaaatgatggttgcgcgtaaggcttcaatgccgcgttcgctggcaacaatataatgcgcgataagcgcaaaggtcgggaaaagtggaatcagcccggcgatataataatttttcgtttttgctaaaacaccaatcaacagcactaccagcgcaccgagcgcggctttgattaccagccccatctttttaccttaacacttccataacaagtcatcagtagaatacctgatgaaaacttgtttagaaacgattgatagtaagtaaaaacagcgcggtgtattgtgacgtttttatatctaccgtgaatgttatgaacactatcgtatttgtggaagatgatgcggaagtcggttcactgattgccgcgtacctggcaaaacatgatatgcaggttaccgtagagccgcgcggcgaccaggccgaagaaaccattttgcgagaaaatccggatttggtgttactcgacatcatgctaccaggcaaggacggcatgaccatttgtcgtgatttacgcgcaaagtggtctggaccgattgttcttctaacctctctcgatagcgatatgaaccacatcctggcactggaaatgggtgcctgcgactatattctcaaaacgacgccccctgctgttttgctagcgcgtttacgtttgcatttgcgtcagaatgagcaagccacactgaccaaaggtcttcaggaaacgtctctgactccctacaaagccctgcatttcggcacgttgaccatcgatcccatcaaccgcgtagtcaccctggctaacactgaaatctcgctctcgacagctgatttcgaattattgtgggaattagctacccatgccgggcaaatcatggaccgcgatgcattgctgaaaaatttacgcggcgtcagttatgacggactggatcgtagcgtggacgtggctatttcgcggttaagaaaaaaactgctcgataacgccgcagaaccttatcgcattaaaactgtgcgtaacaaaggctatctttttgcgcctcatgcatgggaataagcgatgaaaaaactgtttatccagttttacctgttattgtttgtctgcttccttgtgatgtctctgctggttgggctggtgtacaaatttaccgccgaacgcgcgggcaaacagtcgctggatgatttgatgaacagttcgctgtatctgatgcgcagcgaattgcgtgagatccccccacacgactggggtaaaactctgaaagagatggatttaaatctctctttcgatctgcgtgtcgagccactgagtaaataccatcttgatgatatttccatgcaccgactgcgtggcggcgaaattgtcgccctggacgatcagtacacgtttttgcagcgtatcccgcgcagccactacgtgctggcagttggtcctgttccttatctttattatctccatcagatgcgattgctggatatcgccctgatcgcttttattgctatttccctcgcctttccggtgtttatctggatgcgtccgcactggcaggatatgttaaaactggaagcagcggcgcaacgatttggcgatgggcatctcaatgaacgtatccactttgatgagggttcgagctttgaacgacttggcgtcgcatttaaccagatggcggacaatatcaacgccttaattgccagcaaaaaacagcttattgacggtatcgctcacgaactgcgaacaccgttagtgcgcctgcgttatcgactggagatgagcgataacctgagcgccgccgaatcccaggcgttgaatcgtgatatcagtcaacttgaagctttaattgaagagctgctgacttatgcccgactcgatcgcccacaaaacgagcttcatcttagcgaaccagacctgccgttgtggctgtcaacgcatctggcagatattcaggcagtaacgcccgataaaacggtacggataaaaacgctcgtgcaaggccattatgcggcgttggatatgcgcttaatggagcgcgtgctggataatttgctcaataacgccctgcggtactgccattcaacggttgaaaccagcctgctactgtcggggaatagagcgacattaattgttgaggatgatggcccagggattgccccagaaaaccgcgaacatatctttgaaccttttgttcgcctcgatcccagccgggatcgctcaaccggcggctgcgggctggggctggcaattgtccactctatagcactggcaatgggcggtacggttaattgtgacaccagcgaactgggtggtgcccgcttctcgtttagctggccgttatggcataacatcccgcaatttacctctgcctgacactacgcgcacgatggtcaagtcaccacgactgtgctataaaataagtatgttgtaactaaagtggttaatattatggcgcgttacgatctcgtagaccgactcaacactacctttcgccagatggaacaagagctggctatatttgccgctcatcttgagcaacacaagctattggttgcccgcgtgttctctttgccggaggtaaaaaaagaggatgagcataatccgcttaatcgtattgaggtaaaacaacatctcggcaacgacgcgcagtcgctggcgttgcgtcatttccgccatttatttattcaacaacagtccgaaaatcgcagcagcaaggccgctgtccgtctgcctggcgtgttgtgttaccaggtcgataacctttcgcaagcagcgttggtcagtcatattcagcacatcaataaactcaagaccacgttcgagcatatcgtcacggttgaatcagaactccccaccgcggcacgttttgaatgggtgcatcgtcatttgccggggctgatcacccttaatgcttaccgcacgctcaccgttctgcacgaccccgccactttacgctttggttgggctaataaacatatcattaagaatttacatcgtgatgaagtcctggcacagctggaaaaaagcctgaaatcaccacgcagtgtcgcaccgtggacgcgcgaggagtggcaaagaaaactggagcgagagtatcaggatatcgctgccctgccacagaacgcgaagttaaaaatcaaacgtccggtgaaggtgcagccgattgcccgcgtctggtacaaaggagatcaaaaacaagtccaacacgcctgccctacaccactgattgcactgattaatcgggataatggcgcgggcgtgccggacgttggtgagttgttaaattacgatgccgacaatgtgcagcaccgttataaacctcaggcgcagccgcttcgtttgatcattccacggctgcacctgtatgttgcagattaacgcccggctttcatactgccgaccatctgttctggccgtacccagctgtcaaactcggcttcgctaagataccccagcgcaagggccgcagcttttaaggtcagcccttctttatgcgcttttttggcgatctcggcggctttgtcataaccaatgtgggtgttaagcgcagtcaccagcatcagcgattcattgagtaattgattgattcgctcacgattcggttcaatacccactgcgcagtgtttgttaaaactttccatgccatctgccagcaagcgcaccgattgcaggaaattgtggatcaccattggacggaagacgttcagttcaaagttaccggaagcgccccccatgttgatcgccacgtcgttccccatcacctgacagcagagcatggttaatgcctcacactgtgttgggttcactttccccggcatgattgagctgcccggctcattttccgggattgagatttcaccaattccgcagcgcgggccagaggccagccagcggacatcattggcgattttcatcagtgacgcagccaaccctttcaacgcgccgtgcgcctgaaccagggcatcacaggtcgccagcgcttcaaatttgttcggcgcggtaacaaacggtgcacaggtaatgactgccagttcatctgctacgcgacgcgcatactccggatgggtatttagtccagtacccaccgctgtaccgccaagagccagttccgctacgtgaggcaggctgtattcgatatgtttgagattatgctcgagcatcgctacccagccggaaatctcctgccccagcgttaacggcgtggcatcctgcaagtgagtacgaccaattttgacgatatcggcaaaagcacgggatttctcattcagtgtctgtgtcagggttttaagctgaggaatgagttgcttgcgcagcgccagcagcgccgcaacgtgcatcgccgtcggaaagacatcgttggaactttggcttttgttcacgtcgtcgttagggtgaactttacgttccatcccgcgcacaccgccgagtaattcactggcccggttagccagcacttcgttcatgttcatgttactttgcgtgccggagccggtctgccagatagccagcgggaattcgtcgtcatgctgtcctgccagtacttcatccgccgcctgacgaatggcgctcgctttctcttcagacaacaagcctaaatcttcattaacttttgccgctgcacgcttggttagcgccagcgcatgaatcagtgaggtgggcattttctccgtcgaaatgcggaaatgctccagcgagcgttgagtttgtgcgccccacagcttatctgccgggacatcaatcgcccccatcgaatctttttcgctgcgtactgtattcatgacctgctcctcacctgattaattttttctttctgttttgctttcgttaagcaacttttagctcacttattatttaccatttgataacaaatgtttggtctttcgtgccatgtaaaaaaaccgccccgaagggcggctctgtttatttcacacagcgggtgcattgtgtgagttgtatctgctggaagaagtcatttcctttatcatccacaaggataaacgccgggaaatcttccacttcaattttccagatggcttccattcccagttccggatattcaacacattccaggctcttaatacttccctgcgccaatacagcggccggaccaccgatactgccaaggtagaagccgccgtgttttttacaggcatccgtcacctgctggctgcggttgcctttcgccagcatgatcatacttccgccctgcgcttgcagttgatcgacataagaatccatccgtccggcggtcgttgggccaagagaaccggaggcataaccttccggcgttttggccggacccgcgtagtaaatcggatgatctttgatgtactgcggcagcccttcaccgttatccatccgctctttcagtttggcgtgagcaatatcacgaccgacgataatcgtgccgttaagcgataagcgtgtagaaacgggatactgcgacaactgtgcgaggatctctttcatcggacggttaaggtcaacgcgcaccgcttcgccttctcccgctttgcgcagctcttccgggatatatttgcctggattatgttccagtttttcgatccagatcccctgacggttgatcttcgctttgatattacggtcagcagagcaggagacgcccataccgaccgggcaggatgcgccgtgacgtggcaggcgaatcacgcggatgtcgtgagcgaagtatttaccaccaaactgcgcacccagaccaagattttgcgcttcgatcagcaattctttttccagttccacatcgcggaacgcctgaccgtgctcattcccttccgttggcagttcatcatagtatttcgcggaagccagtttcaccgttttaaggttcgtttctgcagaagttccaccaataacgaacgcaatatgatacggaggacaggccgccgtacccagcgtgcgcatcttctcaaccaggtaatttttcagtttccccggcgtcagtaacgctttggtttcctgatagagatacgtcttgtttgccgaaccaccacctttggcgatacagaggaatttgtattcgtcgccatcaacggcataaagatcgatctgcgctggcagattggtgccggtattcacttctttatacatatccagcggcgcgttttgcgagtagcgcagattatcttcgatataagtgttatagacaccgcgcgccagcgccgcttcatcaccaccaccggtccatacacgctgcccttttttaccaacaataatcgcggtgccggtatcctgacaggttggcagaacgcctttcgccgcgatgtcggagttacgcaggaattgcagcgccacatatttatcattttcgctggcctccgggtcacgcagaatgtcggccacctgttgttggtgcgccggacgcagcatgaacgacgcatcatgaaacgcctggcgcgccaacagagttaacgcttcgggtgcgactttcaaaatctcctgcccttcaaattcagatacgctaacgtgttcgctggttagcaggtaatactcagtatcatcttttttgagtggaaaaggagcctgataatgaaagggtttgtttgacattgttctctcacttactgcctggtttggttatgctctgggcgggtgttccgttgccctgttaaaagcgagtaacaatatcctacacacttttttaacaaaaactgagactagtacgactttttgcggctccaggttacttcccgtaggattcttgctttaatagtgggattaatttccacattaaaacagggattgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagcttattaaaggcttataacaccttcaggcggccagtccgcctgatttcattttatggataatcattatgaataaatcgctggtagcggtaggcgtcattgttgcgctaggcgtagtctggacaggcggcgcatggtatacaggcaagaagattgaaacccatctcgaagacatggtcgcgcaggcgaacgcgcaactcaaactgacagctcctgaatccaacctggaagtgagttatcaaaactatcatcgcggcgtattcagcagccagttgcaactgttggtgaaacccattgccgggaaagaaaatccgtggattaaaagcggtcagagcgtcatcttcaacgaatcggttgatcatggtcccttcccgcttgcccagcttaaaaaactgaacctgatcccgtcgatggcatcaattcaaaccacgctggttaataacgaagtaagcaaaccactgtttgatatggcaaaaggtgaaacgccttttgagattaactcgcgcattggttacagcggtgattccagttccgatatttcgctcaagccactgaattacgagcaaaaggatgaaaaagtcgcctttagcggcggcgagttccagttaaatgctgacagagacggcaaagccatctccctttccggggaggcgcaaagtggtcggatagacgcagttaacgaatacaaccagaaagtgcagttgacctttaataatctgaaaaccgacggttccagcacgctggcaagttttggtgagcgtgtaggaaatcaaaaactgtcactggaaaaaatgaccatttcagtggaaggcaaagaactggcactgctggaaggcatggagatcagcggtaaatcggatctggtcaatgacggtaaaacgatcaatagccaactggattactcgctaaacagcctgaaggtacagaatcaggatctgggcagcggcaagctgactttaaaagtcggccagattgatggtgaagcctggcatcagtttagccagcaatataacgcgcaaactcaggcgctgctggcacagccagaaattgccaacaaccccgaactttatcaggagaaagtgacggaagccttctttagcgccctgccgctgatgctgaaaggcgatccggtgattactatcgcgccgctaagctggaaaaacagtcagggtgaaagtgccctgaatctgtcgctgttcctgaaagatccggcaacgactaaagaagcgccgcaaacgctggcgcaggaagtagatcgttcggttaaatctctggatgcgaaactgaccattccggtggatatggcaactgagtttatgactcaggtagcgaagctggaaggttatcaggaagatcaagcgaaaaaactggcgaaacagcaagttgaaggtgcatcagcaatggggcagatgttccgtctgaccaccttgcaggacaataccatcaccaccagcctgcaatatgctaacggtcagataacgttaaatgggcagaaaatgtcgttagaagattttgttggcatgtttgcgatgccagctcttaacgttccggctgtaccggcaattccgcagcagtaattcacggccaaaacgccggagaattttcactccggcgttttcatctgaaaacaaaccagagattgcctgatgcgctacgcttatcaggcctaccttttcctgcaacactttgaatttatgagtttttgtaggctggataaggcgtttacgccgcatccggcataaaaaacgcgcactttgtcaacaatctgaaacgccggagatttttctctccggcgttattttttacttcagcataaagtcatactgaatactcattttcacatcccagtaattcaggcgatcgcccagcgtactgccatcgcgcttttcccgccctttatcggcagcaagaaagaaattcatcccttgtaacggcccttcgctgacccgatagttcataccacctaagatacccgtgccttcaatccgcacatctcgtttactggattcatagccgcgagtcacaatcggtgcaaatgtcagcgtaaattgcggcgttaaacgatagttgacgcccaattgccaggactgcattccttcacggttacgatcaagacttaatgaaaagggatagccaatgtcggtatccaccacggcaccattcattgcatggcgcaaataaccaccactgccaaatacacttccccacggcgcattccaggtcaattgtccactaaccaacgccgtttcattgggctggctggtattacgacttaaaccttcgagctgcgcgtaaaagccgagcaactcccctttcaacgtataattcgggtcgagcggtatgcttttctcgagaatactttgtatctgattggaaacatctttctgtaccgatgcccccagagaatagcgactggtatcatcatgccaactggcggctaaaaaagaacgtgcgcgatgtttatcgtattttcccgtctggctgttatacaccccttcatcacgaataccggttgttgaatcagtccataaaaatactcgtgaacgccacattccccacagatcaatatttggtgttaaagcccaataacctaatgctccttcagaaactgtcggtaatgtacgttgcgaactgccagccattaacggaatacgataaggtaagctaccataactataatccgtcccgaagcgacctaatttaagcaggctattttcactgggttttatttttactgcccccagggcaaagccaaaacttttatcaccatcaagataccaccgggtactcatatcagcacgagcacctaatttataaacataatacgccccgccttcaacgccaataatattggaataataaccactattgaaatcgagcaatcctccctgtacccatgcgtaaatatctcttcccgcgccagcactgggcttatccgccctgcgcaattcgtttttcagtctgatgcgtagtcccgcttcatcgtcagccagttgcgccgcataagcagaggtaaggccagaggcagccgtcaggcaaataacggccatggccactatttttctcatagttgcacctttgatgttctgattatttttattgaatattaattagtgatatcgctgattaattgctgctgcacttttttacgattatcaatttcaaccacgatttctttgaattttttatccgtgagcggataaaaccagataataacgaatgccagtagcataaatccgcaaggtactaaggcaattgatgtgcggatgcccataataacttccggcgtttgcacctgattggcgatatatccgcttaaccccaaaataaaggcaggaattgaacctccgattgcctgaccgcatttacgggtaaatgagaatagtgaataggtgagcccttcaattcgcacgccggtcaggtattcaccgtattctacggtatcagcttccagcgcccacatcacggtcatggtaacgccctgaccaattgaagcgatggccaacgcaaccaacgccaccggcagtgaccagacggaaacccagaagaacagcagataaccgcaggttcccagcaaagcgccaatcaggaaggtattctttttaccgatcctcgcgaccatccccggcaccagcggtgccgatgccacagtaccaaccaggttttgcaccagtaccagcacagtgaacagcccggtatcatttaacacatagcgcacgtagaacaacgacgaggcgctgaccgcaaaggtcgaaatcagcacacacagcgcaccgatgcacaacataaacagcgggcgattccgtttcagggtttgcagactgatattcaatgacggctgcgcaacgatacgtaccacattctcacgcgtcgatttgaagcagatgaagtaaagcaccattccggcaatcgccagcacaattgtccagaaatggtataccgacaccatctcttccgggctggagttcttaatgctcggtcctatcagaaatgccaggcagacaaaggtcaatgaagcggcaatcccacgagccgcgcccagacgggcgcgggattgtggttgttgggtcatcgcggtagcaagtgaaccataaggaatattcaccaggctgtagcaaagcccgaggcccatgtaggtcaaatatgcatacaccactttgctaccatggctccagtcggtcagcacccagaataccagcacgctgaagatcattaacggcgcagtaccgaagagtaaaaacgggcggaattttccccagcgggtattcacactgtccaccactcgtccggcaaagacgtcggcgaaggcatcgaatacccgcaccagtaacagcatggtgcccgccgcagcggcaccgacgccagcgacgtcggtgtagtaactcaacaggaagagcgcccccattgcgaaggcgaagttattggcgacgtcaccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggatcccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacataagggactcctcattaagataataatactggtcaacctttaatctgattagttaaccaattctgtgttgcacacagttatctgtgagaaacccatggaagagaaatggaaataaaaagaactgacaccgcgatcaaaaaaccaaaaactgcaatacccacagcgtgatatagatcgcattaatctttaaaacagcgttgacagaagccataaaataagcaaccgaacgttcgttcgagcgtattgggaacgataaactctcatgacatatggctacagtgaatattttggggggaattctccgaagccgggaaggataatttttgcacagagaaattacgatatgaaacgcgggcacagttatcaccagcccgccgaaaaagagagagaatcaggatgcggttaagataccgccaatcatcgcgcgtaatccctgagcaaacgacgcttcacgcgccaggtcttccgcttcgatatcggccagtacaccgtaggtcagatccagcagtaaacgtgaagtcattgccgtgttgatgtctgggcttatctcgcctttttgctgggcatcacgcatccgctgggcaacaaattccgtgatcgtcatatgcttatttttaagcatggcggcgacctgtgggttacgcatcccttccgccataatttcaaccaccagcgcccgttgtccaaaggcttcatgggtgagagagacaatggactcgaccatatagtcaacgaaatgaatcccttcaatcggttcccggaaacgggccagcgccctctcctggtcctgtaagataatcgcctgaatcaaggcttctttggagatgaaatggtgatagagcgtcccgggactaatggcgcaagatttacagatggctttcatcgaggcactgtgaaatccattttctgaaaaaatctctctggcagcattgaggatccgggtccgtgtcggttgtgcttcagtctgcatgttatccatcattaaaccattatagttagcgtgaataactagtttaccgcgttgtcaggtgagcgcctatcattgctgttgaatagtgcgaaggcacactctattcgtatacttttcactctgaaattggttaaccaatagccgtgatttggctgccagttatttagcagagacgttgatgagtttatcccggtaaacaacacgcacggttgtttaccggtccgttagtgtattaattgagctcctgtaccccaccaccggagacggtgagaatttgtccgcttacccagctcgcagcaggcgagcaaaggaacagcgctgcgttagcaatatcttgcggttggcccagacgtctgatcggcgtgtgctgtaacattttttgttcaatttctggtgtaataacggatttcagggcatcggttaatattgcccccggcgcaatgccatttacccgaatatttttttcacccaggtcaaacgccatatttctgaccagatgactggccgcagctttagatgatgcataggaagtcatgtttatatttttattttctgccgccatagaagtgatggtcagaataacgccaccgccatttttttccatttctggcgcaacaagttgtgacagatggaaaaaagaaaacacattcagttcataagcacggcgaaaatccgccattggcatatcaaacggtttaggtccaccgccaccggcgttgttaaccagaatatcaactttacccagcttactgatagcaaagtctgccagtgcagagagttcctgttcggaagtaatatcacaacggcaggcaaatgcctgaccacccagttgttgaatttcgtctacaacatggttagctgcgtcggcgttaatatcactgaccaccacagatgcgccagctgtcgcgaatgtaatggcgatttctttaccaatacctgcacccgcacctgtgatgatggcgcattttccgtcgagtctcaggttgtcagaattaaacacataaacctcctgtgaacttcagtaaaaataaaaggcaccgcctgtgtgccacattttttatcattaaccttgaggaaaggacactaccaggtatagcagataaagagaggattatttcgctgcaatgagccgggcgggaataataagattgcgtgaatgcgtctcttcatgggtgattttttgcatcatgcgatccgcaagtgtgataccaagttcccgcgctggcgtgctggcccaggtaacaggtatatcatcaagtgtggttggtgtcgcatcggtaaatgccgccagcgaaacctgttgctcaaagtaacgatcgactccgctttccccgctttgccgccctgctttgagcaaaccaaaccatgcccccatcgcaatagtttcgttatagcaaaccacggcactgatggtcgggttatgacgtaaaagcgccgtgatagcttccgcggcttgcttctggctggaagtgcactccaacacccaatcgctatgaaacggcaggccaaattttagtagagttgcacaatagcccccaacccgttctgcacgggttaatgaggaactttgccctcccagccaggcgatccgctgatgcccattgcgaatgagatgctccgtcaacaactgtgcagcctgcatgttgtccgggcgaaccgtatcaacatcatcaagataactggcacgggaagcgaaaatcaccgggatagctttttcttctgccatccgtcgcaggtcatcgctacttcctgcagctccggcaattaccacaccatcgacaccctgattcagtaacagtgaaaaccgctgtgccagctgctcaccgtctttaccgccgtgaagcaaaaaaaccatccgtccctgcgcttccagagcttccgtcaatccggccgtcaattcggcgtaaaacggcgcagataaatcacggacgatcaaaccaatgacgccgctttgcccgccgcgcagcgccgacgcctggcgattgcgcacaaatcccagctcttcaatggcggcgttaacgcgttctcctgtggcggtagagattcgccctttgccactaagcaccagcgaaacggtacttaccgacacgcccgcagccagcgcaacatcatgaatggttatttttttggcggtagccatgcagatgacctactccctgattatgtgacagataaaacgttttaccttttatttatcttatacccgctattatcgttgcgtaatgtgatttatgcctcactaaaatttgataaaacgttttatcttctcgcgcaatttactgaatccagattgttctctacgaggagtcgttttatgacggcgaaaacagcaccgaaagtcacgctgtgggagttcttccagcagttaggcaaaaccttcatgttacccgtggcattattgtcgttctgcggcattatgctcggcattggtagttctcttagcagccatgatgtcataaccctgatcccggtcctgggcaaccccgtgttgcaggctatctttacctggatgagtaagattggctcgtttgcttttagtttcctgcctgtcatgttctgtatcgccatcccgctgggcctggcacgcgaaaataaaggcgtagcggcattcgctggcttcatcggttatgcggtaatgaacctcgcggtaaacttctggttgaccaataaaggcattctgccaaccacggatgccgcggttctgaaagccaataacatccagagcattcttgggatccagtcgatcgataccgggatcctcggtgcggtgatcgccggtattatcgtctggatgctgcatgagcgtttccataatatccgcctgccggatgcgctggcattcttcggcggtacgcgcttcgtaccaattatctcctcgctggtgatgggccttgtcggcctggtgattccattagtctggccgattttcgccatgggtattagcggcttgggccatatgataaacagcgcgggtgatttcggaccgatgctgtttggtaccggtgaacgtctgctgttgccgtttggtctgcatcacattctggtggcattaattcgctttaccgacgcaggcggcacgcaggaagtctgcggtcaaaccgtcagcggcgcactgaccatcttccaggcgcaattgagttgcccgaccactcacggtttttctgaaagcgccacgcgtttcctttcgcaaggtaaaatgcctgcgtttctcggcggtctgccaggtgcagcgttagctatgtatcactgcgcgcgcccggaaaatcgccataaaattaaaggtctgctgatttctggcctgatcgcctgcgtcgttggcggcactaccgaaccgctggaattcctgttcctgttcgtagcgccagttctgtatgtcatccacgcgctgttaaccggcctcggcttcaccgtcatgtctgtgctcggcgtcaccatcggtaataccgacggcaatatcatcgacttcgtggtgttcggtattttgcatggtctgtcaaccaagtggtacatggtgccagtggtggcggcaatctggtttgtcgtttactacgtcatcttccgtttcgctatcacccgcttcaatctgaaaaccccggggcgcgatagcgaagttgccagctcaatcgaaaaagccgttgccggtgcgccgggtaaatcaggttacaacgttcctgcaatcctcgaagcattaggcggtgccgacaatattgtcagcctcgataactgcattacccgtctgcgtttgtctgtgaaagatatgtcgcttgttaatgtgcaggcactgaaggacaatcgggcaattggcgtagtacaacttaatcaacataacctgcaggttgttatcgggccacaagttcagtcagtaaaagatgaaatggccggtctgatgcatactgtccaggcataaggataagatatgttcgatttttcaaaggtcgtggatcgtcatggcacatggtgtacacagtgggattatgtcgctgaccgtttcggcactgctgacctgttaccgttcacgatttcagacatggattttgccactgccccctgcattatcgaggcgctgaatcagcgcctgatgcacggcgtatttggctacagccgctggaaaaacgatgagtttctcgcggctattgcccactggttttccacccagcattacaccgccatcgattctcagacggtggtgtatggcccttctgtcatctatatggtttcagaactgattcgtcagtggtctgaaacaggtgaaggcgtggtgatccacacacccgcctatgacgcattttacaaggccattgaaggtaaccagcgcacagtaatgcccgttgctttagagaagcaggctgatggttggttttgcgatatgggcaagttggaagccgtgttggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggctcgcggagactgggcgttgctaacgtcgggctcgaaaagtttcaatattcccgccctgaccggtgcttacgggattatagaaaatagcagtagccgcgatgcctatttatcggcactgaaaggccgtgatgggctttcttccccttcggtactggcgttaactgcccatatcgccgcctatcagcaaggcgcgccgtggctggatgccttacgcatctatctgaaagataacctgacgtatatcgcagataaaatgaacgccgcgtttcctgaactcaactggcagatcccacaatccacttatctggcatggcttgatttacgtccgttgaatattgacgacaacgcgttgcaaaaagcacttatcgaacaagaaaaagtcgcgatcatgccggggtatacctacggtgaagaaggtcgtggttttgtccgtctcaatgccggctgcccacgttcgaaactggaaaaaggtgtggctggattaattaacgccatccgcgctgttcgttaaccccaattgcgcaacgtaaaaaatcgttgcgcaatcgtggatttttaccctgctttgtttttataatggtgcgcacttttatatccagaaaaagagtgcgaccatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgaccaaacttgactggggcgttaaagttctcgcctctcttgatgcctgtcgccgcgtggcatttgaaaacattgaagatgcagcccgtcacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggcattatgagccggaccttcggcgaagccgcctgtcagcaagagctggaggcctttttagcccaccgtgaccagattaccgcacttgatttagccggtgatgaacttggtttcccgggaagtctgttcctttctcacttcaaccgcgcgcgtgatgcgggctggcatattaccgtccatgcaggcgaagctgccgggccggaaagcatctggcaggcgattcgtgaactgggtgcggagcgtattggacatggcgtaaaagccattgaagatcgggcgctgatggattttctcgccgagcaacaaattggtattgaatcctgtctgacctccaatattcagaccagcaccgtagcagagctggctgcacatccgctgaaaacgttccttgagcatggcattcgtgccagcattaacactgacgatcccggcgtacagggagtggatatcattcacgaatataccgttgccgcgccagctgctgggttatcccgcgagcaaatccgccaggcacagattaatggtctggaaatggctttcctcagcgctgaggaaaaacgcgcactgcgagaaaaagtcgccgcgaagtaacaaaatggatggtgcaaatgcaccatccatttttcatgcaaggcacaaagtcgcgcgatgtttggcggattcgatgcccagctcaatcaactccattacctggattgcctggcttgccggaaccggattttcaccatcgccatttaacgcatcacgaatagccgcatagtaagccggataattcccaggcaccgtcaacagcgtttcttcgacacgttcctcaccttccacgcgggtaagtacgccatcacgcatatcgtagccccagtcttcctgcggtagacgctcgccatttttcagacgttcttcctgtggatcgaggccatatttcacataactgcctcgggatccatgcacgatataccgtgctgactcagcggctgccagcatggtaccgtgtaaaatgactcgccgctgtggataggacaagatggcgtggaaataatcggtcgactgcgctccgggccgtaactgtgccaaatctaccgtcatgctgaccggtaaaccaaaaagcgtaatggcctgatcaagaagatgtggtgctaaatcgtaccagataccgctgcctgggccgccctgttcacgccaacgatcgcgcacctgcggacggaagcggtcaaaatgagactcaaagtaagcaacttcacccagcacgccttccgcgagtaaaccttttagcgtcaagaaatcgctatcccagcgacggttatggaatacagacagcacacgccccaggctttttgccagcgcatccagctctcgcgcttgtgacagtgtcacggtaaagggtttatcaacgaccacatgtttacccgcctcaagcgccgctttggctaacgggaaatgggtatcgttgggtgtaggaatgacaatcaggtctatgttgggatcgttaaacagatgcttcggctcagagacaaccgtaaccgttggccagtcggcttttacttttgtttcatcactgctggagattaccgccagttcctgcccgggcgtgcccgcaatcaggggcgcatggaaggttttgctcgcataaccatacccaatcaacccaacacggatgttgtcgctcatgtcattgcctctcattgaagtatgatggctatttgacactatcctttacccacgctcaacagtttaataacctgccagcaataagggatgttgtttaacttaagtcaaaaaaatagcgaattttccaacgacaaaagctaaatatcgcaaaaacctcagtaaaaatcttgctggagctattattgctaagtaacatttaccccctgaagttaatggatcaatcaagagagatgtgggctgtaatgaatcgtcttattgaattaacaggttggatcgttcttgtcgtttcagtcattcttcttggcgtggcgagtcacattgacaactatcagccacctgaacagagtgcttcggtacaacacaagtaagctctgcacttgtggagcgacatgctgcccgtccgggtgcatgttttcacttgtcggatattaaaccaggaatttattatcttgttcgatgttgttggtgattgtcagggatagtaaagcgcgttactcttttcagagcagtttttcatccctgaatatttgccatcagcgcattcttattattgtaataacacaagcgttcacttttggtgaaattttatcatcactaataatacctacccctttggtattaattattttatggaccttttatgactgttcaggactacttattaaaatttcgcaaaatcagttcactcgaaagtctggaaaaactctacgaccatcttaattacaccctgacggacgatcaggaactgatcaatatgtatcgtgctgccgatcaccgtcgcgcagagctggtttctggcgggcgtttgtttgacctcggccaggtaccgaagtccgtctggcactatgtccaataaagaaagtagcgatcggttataaaagccttataataacgcccctaaaattagatttgcctgtttgcgtcgctattctggagaacctatgaccaccacaacgccacaacgtattggaggctggttgcttggcccgttggcctggcttttagtcgctctgttgagtacgacgctggcgttgttgctgtataccgctgcgttatcttctccgcaaacatttcaaacgctcggcggacaagcactgacgacacaaatcttatggggcgtttcttttattaccgctatcgccttgtggtattacacactgtggttgaccatcgctttctttaaacgtcggcgttgtgttcctaaacactatattatctggctgcttatttccgtattgctggcagtaaaagcattcgctttttcacccgtggaagatggcatagccgttcgccagttgctgtttactttgttggcaaccgcattgatcgtcccctatttcaaacgctcgtcgcgggtaaaagcgacgtttgtgaatccgtaataaccttacagttaacctgttgtcgcctgctctggattaacggataataggcggcttttttatttcaggccgaaaaatgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatggtggtgcgcaaaaccagcccggtgctttaccgtctgctggggatttttttgccgcttatcaccaccaactgtgcagtgctcggcgtggcgttgctgaatatcaatctcgggcacaatttcttgcagtcggcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaatgaatgctatctggattgccgttgccgccgtgagcctgctgggcctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaatcaaccgttgcgccccaggtggcgaagctgtgatgctaaaaattgccgagttgcttaatgtcgagccgcagccgctggatggcgaagcgcaagagataacgcctgcgcggatggtggcggttattgatgaaaataactgtattggctgcactaaatgtattcaggcgtgtccggtagacgccatcgttggcgctacccgtgccatgcatacggtaatgagtgatctctgtacgggctgcaatttatgtgttgatccgtgcccgacgcactgcatctcgttgcaaccggtcgcagaaacacctgactcctggaaatgggatctgaacaccattcccgtgcgtatcattcccgtggaacaccatgcttaagttattctctgcattcagaaaaaataaaatctgggatttcaacggcggcatccatccaccggagatgaaaacccagtccaacggtacacccctgcgccaggtacccctggcgcagcgttttgttattccactgaaacagcatattggcgctgaaggtgagttgtgcgttagcgtcggcgataaagtattgcgcggccagccgcttacccgtggtcgcggcaaaatgctgcctgttcacgcgcccacctcgggtaccgttacggctattgcgccccactctacggctcatccttcagctttagctgaattaagcgtgattattgatgccgatggtgaagactgctggatcccgcgcgacggctgggccgattatcgcactcgcagtcgcgaagagttaatcgagcgcatacatcagtttggtgttgccgggctgggcggtgcaggattcccgacaggcgttaaattgcagggtggcggagataagattgaaacgttgattatcaacgcggctgagtgcgagccgtacattaccgccgatgaccgtttgatgcaggattgcgcggctcaggtcgtagagggtattcgcattcttgcgcatattctgcagccacgcgaaattcttatcggcattgaagataacaaaccgcaggcgatttccatgctgcgcgcggtgctggcggactctaacgatatttctctgcgggtgattccaaccaaatatccttctggcggtgctaaacaattaacctacattctgaccgggaagcaggttccacatggcgggcgttcatccgatatcggcgtattaatgcaaaacgtcggcactgcttatgcagtgaaacgtgccgttattgatggcgagccgattaccgagcgtgttgtaaccctgactggcgaagcaatcgctcgcccgggcaacgtctgggcacggctggggacgccagtgcgtcatttattgaatgatgccggattctgcccctctgccgatcaaatggtgattatgggtggcccgctaatgggctttaccttgccatggctggatgtcccggtcgtaaagattaccaactgtctgttggctccctctgccaatgaacttggcgaaccacaggaagaacaaagctgcatccggtgtagcgcctgtgctgacgcctgccctgcggatcttttgccgcaacagttgtactggttcagcaaaggtcagcaacacgataaagctaccacgcataacattgctgattgcattgaatgtggggcttgcgcgtgggtttgcccgagcaatattcccctggtgcaatatttccgtcaggaaaaagctgaaattgcggctattcgtcaggaagaaaagcgcgccgcagaagccaaagcgcgtttcgaagcgcgccaggctcgtctggagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgcagcaaccgttgctgatccacgtaaaactgccgttgaagcagctatcgcccgcgccaaagcgcgcaagctggaacagcaacaggctaatgcggaaccagaacaacaggtcgatccgcgcaaagccgccgtcgaagccgctattgcccgtgccaaagcgcgcaagctggaacagcaacaggctaatgcggaaccagaagaacaggtcgatccgcgcaaagccgccgtcgaagccgctattgcccgtgccaaagcacgcaagctggaacagcaacaggctaatgccgagccagaacaacaggtcgatccgcgcaaagccgccgtcgaagccgctattgcccgagccaaagcgcgcaaacgggaacagcaaccggctaatgcggagccagaagaacaggttgatccgcgcaaagctgccgtcgaagcggctattgcacgcgccaaagcacgcaagctggaacagcaacaggctaatgcggtaccagaagaacaggttgatccgcgcaaagcggcagttgccgcggctattgcccgcgctcaggccaaaaaagccgcccagcagaaggttgtaaacgaggactaaatggtattcagaatagctagctccccttatacccataaccagcgccagacatcgcgcattatgctgttggtgttgctcgcagccgtgccaggaatcgcagcgcaactgtggttttttggttggggtactctcgttcagatcctgttggcatcggttagtgctctgttagccgaagctctcgtactcaaactacgcaagcagtcggtagccgcaacgttgaaagataactcagcattgctgacaggcttattgctggcggtaagtattccccccctcgcgccatggtggatggtcgtgctgggtacggtgtttgcggtgatcatcgctaaacagttgtatggcggtctgggacaaaacccgtttaatccggcaatgattggttatgtggtcttactgatctccttccccgtgcagatgaccagctggttaccgccacatgaaattgcggtcaacatccctggttttatcgacgccatccaggttatttttagcggtcataccgccagtggtggtgatatgaacacactacgcttaggtattgatggcattagtcaggcgacaccgctggatacatttaaaacctctgtccgtgccggtcattcggttgaacagattatgcaatatccgatctacagcggtattctggcgggcgctggttggcaatgggtaaatctcgcctggctggctggcggcgtatggttgctatggcagaaagcgattcgctggcatattcccctcagcttcttagtaacgctggcgttatgcgcaatgttgggctggttgttctcaccagaaacactggcagcaccgcaaattcatctgctgtctggagcgaccatgctcggcgcattctttattttgactgacccggttaccgcttctacgaccaatcgtggtcgtcttattttcggcgcgcttgcgggcttattagtctggttgatccgcagtttcggcggctatcctgacggcgtggcttttgccgtcctgctggcgaacatcacggttcctctgatcgattactacacgcgtccgcgcgtctacggccatcgcaaagggtaaaccatgctgaaaactatccgaaaacacggcattacgttggcgctatttgcagcgggttcaacagggttaactgcggccatcaaccagatgaccaaaacgacgattgctgaacaggccagtctgcaacaaaaggcgttatttgatcaggtgctgccagccgaacgctataacaatgcgctggcacagagttgctatctggtaactgcgccagagttaggtaaaggtgagcatcgggtttacatcgccaaacaggatgacaaaccggtagccgccgttctggaagcaaccgcgccagatggctattccggtgcgattcagctgctggtgggagccgattttaacggcacggtacttggcacgcgcgtgacagagcaccacgaaacgccagggcttggcgataaaatcgaactgcgcctttctgactggatcacccattttgcgggtaaaaaaatcagtggtgcagatgatgcgcactgggcggtgaagaaagatggtggtgatttcgaccagttcaccggcgcgacgattactccccgcgcggtggttaatgcggtaaaacgcgccggattgtacgctcagacgttaccggcacaactttctcaacttcctgcctgtggagaataaagcgtgagcgaaattaaagacgttattgttcaggggttgtggaaaaacaactctgcgctggtccagttgctcggcctttgtcctctgttggcggtcacgtccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacattgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaagaatgaaaaagcgccgtgctgaagcagctgcagaacgtgcattgccaaacggtgaaacagggaatgtctgatgaataaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggcgaatacgcctgcagcgatgcttgaactgggcgttgaaggggtgaaaacctatatcaaaacgattgggctttataacagcaaagcagaaaatatcatcaaaacctgccgtatcttgctggagcagcataatggcgaggttccggaagatcgtgctgcgcttgaagccctgcccggcgtaggtcgtaaaacagccaacgtcgtattaaacactgcattcggctggccgactattgctgtcgacacgcacattttccgcgtttgtaatcgtactcaatttgcgccggggaaaaacgtcgaacaggtagaagaaaagctactgaaagtggttccagcagagtttaaagtcgactgccaccattggttgatcctgcacgggcgttatacctgcattgcccgcaagccccgctgtggctcttgtattattgaagatctttgtgaatacaaagagaaagttgacatctgaagaaaaggggtaacaccgattaccccattgataacctttctttatcctcttttaaaacatctttttaacgtcaatgatgccattgcttagcgttatcatcaggtaatccgtttgcggataaccaaaaatgcaggttaattgtttttttaatagcgaaattttctattcattcgtgatcaagatcacgatgctgtcgcaatgtaaaaacattgcaagaatcaggttaaaatcatttaaatttacacacgcaacaaatattgacctacaaaacattacactggctatttttcagaaactggactatctcactagtaaaaacgctaaatagcagaacatatcgccgttaagccatcacccccctctcagtgcagtgaaaaaatctgccgttacgttttttgaaaaatttaacgctggataacatttcccggaatggttgaattccccgcctcagttatatgtaacagattattacaaaggacttgtctgaaagtgcaagatagtgaacattacctgccgtttcccctcccactataacaattgcgcgtatgttttttatacataacgcgagaaagcacccccgttaatatgggatgtaaaaaaagaggtaaaagtgtccactgcaaaccaaaaaccaactgaaagcgtcagtttgaacgctttcaaacaaccgaaggcgttctatctcatcttctcgattgagttatgggaacgttttggttattacggcctacaaggaattatggctgtttacctggttaaacaactgggtatgtctgaagcggattcaatcacccttttctcttcctttagtgccctggtttatggtctggtcgctatcggcggctggttaggtgacaaggtactgggtactaaacgcgtaattatgctcggcgctattgtgctggcgattggttatgctctggttgcctggtctggtcacgacgccggtatcgtttatatgggtatggcggctattgcggtcggtaacggcctgtttaaagctaacccgtcttctctgctttctacatgctatgagaaaaacgacccgcgtctggacggtgcattcaccatgtactacatgtccgtcaacatcggctctttcttctctatgattgctacgccgtggctggccgcgaaatacggctggagtgttgcgtttgcgttgagcgttgtaggcctgctgatcactatcgttaacttcgccttctgccaacgctgggttaaacagtacggttcaaaaccagacttcgagcctatcaactaccgtaacctgctgctgaccattattggtgttgtggcactgatcgctatcgccacctggctgctgcacaatcaggaagttgcgcgtatggcgctgggcgttgttgccttcggtatcgtggttatcttcggtaaagaagccttcgcgatgaaaggtgctgcgcgtcgtaaaatgatcgttgccttcatcctgatgctcgaagccattatcttcttcgtgctgtacagccagatgccaacgtcactgaacttctttgcgattcgtaacgttgagcactccattctgggtctggccgtagaacctgagcagtatcaggcactgaacccgttctggatcatcatcggtagtccgattctggccgctatctataacaagatgggcgataccctgccgatgccaaccaagtttgcaatcggcatggtgatgtgttctggtgcgttcctgattctgccgctgggtgcgaaattcgcgtctgacgctggtatcgtgtctgtaagctggctggtcgcaagctatggcctgcagagcatcggggaactgatgatctctggtctgggtctggcaatggttgctcaactcgttccgcagcgtctgatgggcttcattatgggtagctggttcctgaccactgccggtgcaaacctgattggtggttatgttgcgggtatgatggctgtgccggataacgttaccgatccgctgatgtcactggaagtctatggtcgcgtattcttgcagattggtgtcgctactgccgttattgcagtactgatgctgctgaccgcgccgaaactgcaccgcatgacgcaggatgacgctgcagacaaagcggcgaaagcagccgtagcgtaaaattcagggaaactcttttacaagccgctaacttttcgttagcggctttttttttgttcagcaacgcactaccatactttaaaccacagacaaaaggagttaccgatgaaattgttctacaaaccgggtgcctgctctctcgcttcccatatcaccctgcgtgagagcggaaaggattttaccctcgtcagtgtggatttaatgaaaaaacgtctcgaaaacggtgacgattactttgccgttaaccctaaggggcaggtgcctgcattgctgctggatgacggtactttgctgacggaaggcgtagcgattatgcagtatcttgccgacagcgtccccgaccgccagttgctggcaccggtaaacagtatttcccgctataaaaccatcgaatggctgaattacatcgccaccgagctgcataaaggtttcacacctctgtttcgccctgatacaccggaagagtacaaaccgacagttcgcgcgcagctggagaagaagctgcaatatgtgaacgaggcactgaaggatgagcactggatctgcgggcaaagatttacaattgctgatgcctatctgtttacggttctgcgctgggcatacgcggtgaaactgaatctggaagggttagagcacattgcagcatttatgcaacgtatggctgaacgtccggaagtacaagacgcgctgtcagcggaaggcttaaagtaatagccatcggcccacaggtcgttgtgggccgaaatgagatatttcagagctttgttgcgctgaagtaatgttctggtttggcaatacgatcctgagcagccaccacttgcagctcatattcctgcattgctttggtggtcaccatgatttcgtagactgcagcggtcacatgttccagcgcctcctgcagcgttgccccctgaagcagtttcaccagcagtaaaccgctcgtcacatcaccaacacctaccggctggcgcataccaaaatccaccagcggacggctgatatgccaggcttcatcggcggtgaccagcagcatttcaaaacggtcacggctgtagccagctcgcgccaggtgtttaaccaacacaatttgtggcccttgcgcaatgagttcgcgcgctgccagaaccgcttcttcgacgttatttaccgcatgctcacagagtatttccagctcaaccagatttggcgcaatgatatcgctggcaggcaaaccgtgccgcacatgaaactctgcgacacccggtgcaacgatacagcctttttccggatgacccattaccggatcgcaaaaatatttcgcctgcggattcgcggctttcacctgacggacgataccgaggatatgttcaccctgctccgccgatcccagatagccacttaatacggcatcacaggtgtgtaatttatcaatggcggcaatgccttgcacaatttcggttaaatggctgggcggcatcacgcagccagtccatttgccgtattgggtgtgattagaaaattgaacggtgttcagcggccagacgttcgcgcccaggcggcgcatcggaaactctgccgcactgttacccgcatgaccataaacaacgtgagactggatagcgagaatatttttcatcatgttccctgtataaaaaccagggggagtgatttctcactccccctttccacttaatgcattatttccagcaaatcagacagtaattctttttaccgcgacgcagtaaggtaaaacgaccaaacagacgatcttcttctttaaagaagtattcaggatcggactgtttttcaccgttaatggtgatggcattggaggcgatagttttacgtgcctgaccacgggaaggttgcagttcagaatcgaccagtgcctgcatcaggtctgcgcccttttccatctcaaccatcggtacgccgtcctgcgccagctgttcgaagtccgcttcactcagcgcactcaaagaaccgctgaacaggcattcggtaatacgttttgccgcctgtaaaccttcttcaccgtgaaccagacgagtcacctgctccgccagtacatactgggcgcgcggtgctttaccgctgtttttatcttcttcttccagggcgttgatctcttcaatgctcataaaggtgaagaacttcaggaagcggtaaacgtcggcatccgcagtgttgatccagaactggtagaatttgtacgggctggttttcttcggatccaaccagactgcgccgccttcagttttaccaaatttggtgccatctgctttagtgatcagcggaacggtcaggccaaacacctgattctgatgcagacgacgggtcaggtcgataccagaagtgatgttaccccactggtcagaaccaccaatttgcagcaccacaccgtactgtttgttcagacaggcgaagtcataaccctgcaacaggttgtaggaaaactcagtgaacgaaatcccctgatcttcacggttgagacgctgcttaaccgcttctttgttgatcatctggttaacggagaagtgtttgccaatatcgcgcaggaaggtcagcacattcatattgccgaaccagtcatagttgttcgccgcgatagcagagttttctccacagtcgaaatcgaggaacggggcaacctgcttacggattttgtccacccactcctgaacagtttcttcggtgttcagcttacgctcggcagctttgaagctcgggtcgccaatcagacccgtcgcgccgcctaccagcgcaaccggcttgtggcccgcctgctggaagcgtttcaggcataacaatggaacaagatgccccaaatgcaagctgtcagcggtaggatcgaagccgcaatagagcgcgatcgggccttgcgccagtcgctctgctaacgcttcctcgtccgtcacctgggctaccagcccccgctcttgcaattgtttaatcaagttactgcttgccatcaaaatctccatgtatataacgactgcacctttgccggtacacgacttttcgccagatgcgaaagagacatagaataaagtgccagaatcaggagtaccagcgattaaagcaagatttttgcatcttttcagggtgcaagacgatcaatcttccacgcatcattttcacgctggtacaaaaagcggtcatgcaggcgatgctcaccaccctgccagaactcaatctgttcaaggctgacgcgaaaaccgccccaaaagctcggcaatggcacttcgccctgttgaaacttctgcttcagctccaggaatttactttcaaggataccgcgggcagaaatgcgactggactgcttcgaaacccatgcaccaatctggctatcacgcgggcggctatgaaaatatttcatcacttcgagagtcgaaagtcgttctgctttaccgatcaccatcacctggcgctcaagggtatgccacgggaacagcaggctaacgcgcggattattttcgatttgatgtgctttacggctgccgaggttggtgtaaaacaccatgcctttttcgtcgtaatgtttgagtaaaacgatgcgctgataaggctgaccatgttcatccacggtagcgaccaccatcgcggtagggtccgccagtttggcttcacaagcctgagagagccaacgttcaaaaagggttaatggatcggcgggaagatcgcggcggcgtaacccgcctttggtgtattcacggcgcagatgcgcgatttgctgcaattcgtcgttatcagacatggttttctttacggattgtcagtgggtgacgctattgtgcgccgcccctggaaaaatctcaacgctgtggattttgtaactgacagttattcaagacgatgcggtcgcgtttatagacagtcgcttcatcgcctttcgaccagaaaacatagattccgtcagtgtaacgcgcgccagaggctgaaatgccctgtttgagatgcagtagttgattatcgtaaacaaaactgacctcctggcgcggattattcagtttgaccgtcaacggtttttcatcacactggtattccagcgtatcggtttgcatgcgctcaaccagctgattaaaggcgctacagccggagagaaggaccggcaaaatgataattaacagttttttcatagtcatatcccgaagactttcctggtctggagggcaatacgccctccctaacgttccaagtgtaacggcagacgcggtaagaaaaattcagttaactctgatatcacgggttagcggggaaaatagcccccagtaccgtctcctggcttgcgccagtgacggaaggcagatttcctggtaatcccgccagcgtccgccaggcaagccaggcgaaagccaatgcttccatgtcatcgccactaatgccaacggcatcggtggtggtgacttctgtgcctggcagtaatgccgccagacgcgccatgagtagcggattacgactacctccaccacataccatcaatcgttcgcagccaccgctcaacaaaacttgttcagaaatggtcacggcggtgagttctgccagtgtcgcctgcacatctcggggatcaacacccggaaaatggcgcaaatggcgctccagccaaccatagttaaagtattcgcgtccggtgcttttcggtgcaggttgcgagaaatacgggtcgctgagcatattttgcagcagtgggagaataactttacccgcccgtgcccactcggcatctttatcgtaaggtttaccggcctgacgccagatccaggcatccatcagcatgttaccaggaccggtatcgtagcccccaaccggctgcccaggaatgagcagtgacagattggcgatgccgccaatattgagcaccattcgtcgctcggttgggtgagccagcagcgcatgatggaacgcaggtaccagcggtgcgccttgtcctcccaaggcaatatcgcgacggcgaaaatcaccgacaaccgtaattccggtgcgtgccacaatttgattgttatcgccaatctgtaaagtgtgtggtgccacgcccgtcggttcatgccagacggtttgaccgtgacaaccgatcgcaactatatctcttgcctgcagattttgttccttaagcaaggcattgaccgcatcagcaaaaagttgcccgagttgagtatcaagctgtccaaactgcgaaagtgtaagctgctggccctggcaaatatccagtacagcctgtttcagagataccgggatcggccaactcaaacttgccagctgtgcgacccggtgttcatcaattgtcgccaacacaacatcaacaccatcaaggctggtgcctgacataacgccaataaagcggcccgatttcatagttcatcctttttcaatctgacgtttgcgcaccactcaaacataaacttttcgtgaataccatgcggaatgaccgatttttaccgttggtagtaaaacattatcttcaaatcaataatcatcatgaatgttttgtttataattggttgatcctactttcattatgatttgctcatatttggtagaacatgtaaccatggattcacatatgccatatactttgaccatgagggatgcttgcgtggcgtttcatggtgaacaggagatttttcaatgattaaacgcgtattggttgtttcaatggtaggtctgtctcttgtcggttgtgttaataacgacaccctgtcaggggatgtttataccgcttctgaagcgaaacaagtacagaatgtcagctatggcaccatcgttaacgtacgtccggtacagattcagggcggtgatgattccaacgttatcggtgcaattggcggtgctgttcttggtggtttcctggggaatactgttggtggcggaaccgggcgttctctggctactgcagcaggcgctgttgcaggtggcgtagctggtcagggcgtacagagtgcaatgaacaaaacgcagggtgtcgagctggaaattcgtaaagacgatggtaataccatcatggtggtacagaaacaaggcaacactcgtttctctccgggccaacgtgtcgtactggccagcaatggcagtcaggtgaccgtttctccgcgctaaataagtttgcgtgtggtcaggttactgaccacacgcccccttcatttcaccctttggcctgtaactcaatgatattatgctcaagttttgcgatgagcgtaatcagttgctccagttcctctgcggagatgccatgtaatatttccgcgcgggttttgttaataacagcttccatttcgctgatcagcggctctgccttttccgtcagtttaatacgtttagcccgacgatcgctggcacaagtttgacgcgaaattaaccctttttcttccagttggtccagagtacggaccagtgatggctgctcgatgccaatcgcttttgccagttgaatttgcgactggtctggaggtaactgatggatattgtgtaacgtaacccaatgggtttgtgttaactccagcggtttcaggcgatggtctatcagagcacgccatatgcgcaccaaccgtgccagatcagaacctagtggcgattccaatttcatctccttataattagcttgctaagatattatgcggcttttagaatagtgtgcagcaattgtattgctaaaacaaatgtattgctgcatttggttaccgtcagacatatttttcagaaattgcgcgtaaatttttcgcacttaaagaatatttattaatctaacgcaatatattcggtcgtaaaggaatctactttgtgaagtttatgctcaatgcaacaggattgcccttacaagatctggtgttcggtgcgtccgtctactttcctccgtttttcaaagcattcgcgtttggattcgtcatctggcttgtcgtacaccgcctgcttcgtggctggatctacgccggtgacatctggcatcccttgttaatggatttatcgctgtttgcgatttgcgtttgccttgctctggcaatactgattgcgtggtaactatgtcaattaaaacaattaagtatttctcaacaatcattgtagcggtagttgcggttcttgccggatggtggctgtggaattattacatgcaatctccgtggacacgcgacgggaaaatacgcgcagaacaggtttctatcaccccacaggtgtcgggacgtattgttgagctgaatataaaagacaaccagctggttaacgcgggggatcttctgctcacgatcgataaaacgccctttcagatcgccgagctgaacgcacaggctcagctggcgaaagcgcaatctgacctcgcaaaagccaataacgaagcgaatcgtcgtcgtcatctctcacaaaattttatttctgccgaagaactcgataccgctaacctcaatgttaaagcgatgcaggccagtgttgatgccgcacaggcgacgctgaaacaggcacaatggcaactggcgcaaacggaaattcgcgccccggtgagtggatgggtgactaaccttactacccgcatcggcgattacgctgataccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtttccagtatcggtcgggcgatttatgatcagagcgttgaaagtgactcaagccttattccggatgttaaacctaacgtcccctgggttcgactcgcccaacgcgttcccgtccgctttgcgctggataaagtcccaggcgatgtcacgttggtgtcgggcaccacctgtagcattgccgtaggtcaataatgaacgcatcgtcatggtccttgcgcaatttgccctggttcagggccacgctggcgcaatggcgttatgcgttacgcaataccattgccatgtgtctggcgctgacggttgcctattatttaaatctggatgaaccctattgggcgatgacctcggctgcagtggttagctttcccaccgttggcggtgttatcagcaaaagcctcggacgcatcgctggcagtttgctcggagccattgcggcactgcttcttgccgggcatacgctcaatgagccgtggttttttctattgagcatgtcggcgtggcttggcttttgtacctgggcctgtgcgcacttcacgaataacgtcgcgtatgcatttcaactggcgggctacacggctgccatcatcgcctttccgatggttaatattactgaggccagccagctgtgggatatcgctcaggcgcgcgtttgcgaggtaatagtcggtattttgtgcggcggcatgatgatgatgatcctgccgagcagttccgatgctactgcccttttaaccgcattgaaaaacatgcacgcccgattactggaacatgccagtttactctggcagcctgaaacaaccgatgccattcgtgcagcacatgaaggggtgattgggcagatactgaccatgaatttgctgcgtatccaggctttctggagccactatcgttttcgccagcaaaacgcgcgccttaatgcgctgctccaccagcaattacgtatgaccagtgtcatctccagcctgcgacgtatgttgctcaactggccctcaccgccaggtgccacacgagaaattctcgaacagttgctgacggcgctcgccagttcgcaaacagatgtttacaccgtcgcacgtattatcgccccgctacgcccgaccaacgtcgccgactatcggcacgtcgccttctggcagcgactacgttatttttgccgcctttatctgcaaagtagtcaggaattacatcgtctgcaaagcggtgtagatgatcataccagactcccacggacatccggcctggctcgtcataccgataacgccgaagctatgtggagcgggctgcgtacattttgtacgttgatgatgattggcgcatggagtattgcttcgcaatgggatgccggtgccaatgcattaacgctggcagcaattagctgcgtactctactccgccgtcgcagcaccgtttaagtcgttgtcacttctgatgcgcacgctggtgttactttcgctattcagctttgtggtcaaatttggtctgatggtccagattagcgatctgtggcaatttttactgtttctctttccactgctggcgacaatgcagcttcttaaattgcagatgccaaaatttgccgcattgtgggggcaactgattgtttttatgggttcttttatcgctgtcactaatcccccggtgtatgattttgctgattttcttaacgataatctggcaaaaatcgttggcgtcgcgttggcgtggttagcgttcgccattctgcgtccaggatcggatgctcgtaaaagccgccgccatattcgcgcgctgcgccgggattttgtcgatcagctaagccgccatccaacactgagtgaaagcgaatttgaatcgctcacttatcatcacgtcagtcagttgagtaacagccaggatgcgctggctcgccgttggttattacgctggggtgtagtgctgctgaactgttctcatgttgtctggcaattgcgcgactgggaatcgcgttccgatccgttatcgcgagtacgggataactgtatttcactgttgcggggagtgatgagtgagcgtggcgttcagcaaaaatcactggcggccacacttgaagaattacagcggatttgcgacagccttgcccgtcatcatcaacctgccgcccgtgagctggcggcaattgtctggcggctgtactgctcgctttcgcaacttgagcaagcaccaccgcaaggtacgctggcctcttaattacttaattacaccacaggcatagcgttcaccgccaccgcccagcggtttaggttgatcggacatattatcgccgccaacgtggaccatcagcgctttgtctttgatttcatccagtgatttcagacgaggcgcgatgacggcatcggtagctttgccgtcattattgacgaccagtgcaggcagatcgcctaaatgcccggcaccttctggcccttcatgtttaccggtattttgtggatcaagatgcccgcctgcggattccgcggcgctggctttgccatctttggtggctggctggcagcttcctttggcatgaatatggaagccatgttcaccggggggtaatgctttcagatcgggcgaaaactccagacctttatcggtttcagtaatggtgacgctaccaattgactgccctaccccttgcgacgtgacgaggttcatctcgactttttcactggcagcttgtgcgccggttgcaacaaccagcgccagaatagccagactaaaacgtttcataggacctccgttcattgtgcattcctgaataagtgtaaaccagtgacacatttttgaacggcggctattcctaaaagtgcttacggtacgtcgtaccccagtgccgctttacggatacgaaaccattgttgacgggtcattttcagtgtttctgcttcgacagctgcccgtacgcgctcaattttacctgaaccgataattggcagcggctgcgatggtaaacgtaatacccaggcgtaaaccacctgttcaatcgagcccgcgtttaactcctctgccaccacagccagttcatcacgcagcggctggaaataatcatcattaaacagacgaccaccaccaaggcaggaccacgccatcggacgaacacgcagttgttgtagttggtcgagcgtgccatccagcagtaacggctgatgcaccggggatatttccacctgattagtggcaagggtaaacggcagacgtgattgcaacagggcaaattgcgcaggcgtaaagttcgatacgccaaaatgacgcactttgccgctctgatgcagatgtttgaacgcgtccgccacttcatcggcatccattaacgggtctggtcggtggattaacagcaaatccagatgatcggtcgcgagattaattagcgactgttcggcgctcttaatgatgtgatcgcggtcagtgatgtaatgaccaatgacgttttcttcacgcgcggtcgtcgcgataccgcatttactgacgatttccatccgttcacgcaggtgaggtgccagtttcagtgcctcgccaaacgccgcttcgcactgatagccaccataaatatcagcatggtccacggtggtcacgccgagatccagatgctcttcaataaaactgaccagctggcgggcggacatattccagtccatcaatcgccagtagcccatcacaaaacgggaaaactccgggccttgcggcgcaatagtaatacgctgaaccataatcgcttcctcttatcagatatgagaggagtatacgcaagattaggttcaaaagagtgatggttgctccggttcgtctgatgacgctggcttatttgcgcgtaatttgcgcattaatcgctgccgacaaaggcgcagcacctcttgtttttcgccatcgctcattttattccagttaaaacgctcatcacgactacgaaaacagccgcgacaaaacccgcgttcgtcagactggcaaattccccggcacgggctctggacgggaaagaactctaattgctccgccacttcgccctcctcagataagattattaccattattgaagctgttaatgtccaaagtagcaactttgcttgcactagaccgactggtctactacactccaacgcatgaacaaacacaccgaacatgatactcgcgaacatctcctggcgacgggcgagcaactttgcctgcaacgtggattcaccgggatggggctaagcgaattactaaaaaccgctgaagtgccgaaagggtccttctatcactactttcgctctaaagaagcgtttggcgttgccatgcttgagcgtcattacgccgcatatcaccagcgactgactgagttgctgcaatccggcgaaggtaactaccgcgaccgcatactggcttattaccagcaaacactgaaccagttttgccaacatggaaccatcagtggttgcctgacagtaaaactctctgccgaagtgtgcgatctgtcagaagatatgcgcagcgcgatggataaaggtgctcgcggcgtgatcgccctgctctctcaggcgctggaaaatggccgtgagaaccattgtttaaccttttgtggcgaaccgctgcaacaggcacaagtgctttacgcactgtggcttggcgcgaatctgcaggccaaaatttcgcgcagtttcgagccactggaaaacgcgctggcccatgtaaaaaacattattgcgacgcctgccgtttagcaggcattttttatcaccagacgaccgggagcctttatgtcatctgaaaaactgtattccccactgaaagtgggcgcgatcacggcggcaaaccgtatttttatggcaccgctgacgcgtctgcgcagtattgaaccgggtgacattcctaccccgttgatggcggaatactatcgccaacgtgccagtgccggtttgattattagtgaagccacgcaaatttctgcccaggcaaaaggatatgcaggtgcgcctggcatccatagtccggagcaaattgccgcatggaaaaaaatcaccgctggcgttcatgctgaaaatggtcatatggccgtgcagctgtggcacaccggacgcatttctcacgccagcctgcaacctggcggtcaggcaccggtagcgccttcagcacttagcgcgggaacacgtacttctctgcgcgatgaaaatggtcaggcgatccgtgttgaaacatccatgccgcgtgcgcttgaactggaagagattccaggtatcgtcaatgatttccgtcaggccattgctaacgcgcgtgaagccggttttgatctggtagagctccactctgctcacggttatttgctgcatcagttcctttctccttcttcaaaccatcgtaccgatcagtacggcggcagcgtggaaaatcgcgcacgtttggtactggaagtggtcgatgccgggattgaagaatggggtgccgatcgcattggcattcgcgtttcaccaatcggtactttccagaacacagataacggcccgaatgaagaagccgatgcactgtatctgattgaacaactgggtaaacgcggcattgcttatctgcatatgtcagaaccagattgggcggggggtgaaccgtatactgatgcgttccgcgaaaaagtacgcgcccgtttccacggtccgattatcggcgcaggtgcatacacagtagaaaaagctgaaacgctgatcggcaaagggttaattgatgcggtggcatttggtcgtgactggattgcgaacccggatctggtcgcccgcttgcagcgcaaagctgagcttaacccacagcgtgccgaaagtttctacggtggcggcgcggaaggctataccgattacccgacgttgtaatccaacattgcgagcggcgtaaagccgccgctatactaaaacaacattttgaatctgttagccattttgaggataaaaagatgcgtcttcttcataccatgctgcgcgttggcgatttgcaacgctccatcgatttttataccaaagtgctgggcatgaaactgctgcgtaccagcgaaaacccggaatacaaatactcactggcgtttgttggctacggcccggaaaccgaagaagcggtgattgaactgacctacaactggggcgtggataaatacgaactcggcactgcttatggtcacatcgcgcttagcgtagataacgccgctgaagcgtgcgaaaaaatccgtcaaaacgggggtaacgtgacccgtgaagcgggtccggtaaaaggcggtactacggttatcgcgtttgtggaagatccggacggttacaaaattgagttaatcgaagagaaagacgccggtcgcggtctgggcaactaatctcctgccgggcgtgaactcatcgcgcccgcatctttactgcatcgacaagtaatatttgtcataatgcgcgctgcaatttatccgtattaagagaatcagatgtccgataacgctcaacttaccggtctgtgcgaccgttttcgtggtttttatcctgttgtgatcgatgttgaaacagccggatttaacgccaaaaccgatgcgctgcttgagattgccgccatcaccctgaaaatggatgaacaaggctggctgatgccggacaccacattacatttccacgtcgaaccatttgtcggcgcaaatttgcaaccagaagccctcgccttcaacggcattgacccgaacgatcccgatcgcggcgcggtcagcgaatacgaggcgctgcacgaaatttttaaagttgtacgtaaaggtattaaagcgagcggctgtaaccgcgccattatggtggcgcacaatgccaattttgatcacagctttatgatggccgccgcagaacgcgcctcactgaaacgtaacccgttccaccctttcgccacttttgacactgctgcactggccgggctggcactcggacaaaccgtattgtcaaaggcttgccagaccgctggcatggacttcgacagcacccaggcgcactccgcgctgtacgacaccgaacgcactgctgtgctgttttgtgaaatcgtcaaccgctggaaacgtctgggaggctggccgctatctgccgccgaagaggtgtaatcgagtcgatgcctgatgacatgcaatgattcaggcatctatagtgaggctattccacgcatcctgcatgatattcacggggaatagcgttaatggcagataatccagacccttcatcgctcctgccggacgtgttttcaccggcgacccgcgactggtttcttcgcgcctttaaacagccgaccgctgtccagccgcaaacctggcatgtggcggcgcgaagcgaacatgcgctggtgattgcaccgaccggctccgggaaaacgctggcagcatttctctacgccctcgatcggctcttccgcgaaggcggcgaagatacccgcgaggcgcataagcgtaaaacctcacgcatcctctatatttcaccgataaaagccctgggcaccgacgttcagcgcaacttgcagatcccgttgaagggtattgccgatgaacggcggcggcgcggcgaaacggaagtcaatcttcgcgtagggatccgtactggcgatacgcctgcacaggaacgcagcaaactcacccgtaatccgccggatattctgatcaccacacccgaatcactctatctgatgctgacctcccgcgcgcgcgaaacgctacgcggcgtcgaaacggtaattattgatgaagtccacgcggtagcgggcagtaaacgtggtgcgcatctggcgttaagtctggagcggctcgatgcgctgctccacacctcagcacagcgaattggcctttctgccactgtgcgctcagccagcgatgtggcagcatttcttggtggcgatcgcccggttacggtagtcaacccgcccgcaatgcgccatccgcagatacgaattgtcgtaccggtcgccaatatggatgatgtctcatcggtcgccagcggcaccggcgaagacagccatgccggccgggaaggctccatctggccatatattgaaacgggtatccttgatgaagtgttgcgccatcgctcgaccattgtctttactaattcgcgggggctggcggaaaaactgacggcacgattaaatgagctttacgccgcacgcttacagcgttccccgtctatcgccgttgatgcggcccatttcgagtcgacctccggcgcaacctctaaccgtgtacaaagtagcgacgtttttattgcccgctcacaccacggctccgtctctaaagaacaacgagcaatcaccgaacaggcgctgaaatcgggtgaattacgctgcgtggtcgcaacctccagtcttgaactggggattgatatgggcgcggtggatctggtgattcaggtggcaacgccgctttctgttgccagtgggttacaacgcattggtcgcgccggacatcaggttggcggtgtatctaaagggctgtttttcccccgtacccggcgtgatttagtcgattccgcagtcattgtagagtgtatgttcgcaggcaggctggaaaacctgacaccaccgcataatcctctcgacgtccttgcgcagcaaaccgttgccgccgcggcgatggatgcattacaggtagacgaatggtactcccgcgtacgccgtgccgcaccgtggaaagatctgccaagacgtgtttttgacgccacgctggatatgctttccgggcgctatccctctggcgatttttctgcttttcgccccaaactggtctggaacagggagaccgggatattgaccgcccgacctggcgctcaattgttggcggttaccagcggcggcaccattccggatcgtggcatgtatagcgtgttattacccgaaggtgaagaaaaggccggttcgcggcgggtgggtgaactggatgaggagatggtatatgagtcgcgggtgaacgacattatcactctcggcgctacctcatggcggatccagcaaatcacccgcgatcaggtgattgtgactcctgctccgggtcgttctgcccggctccccttctggcgtggtgaaggtaacggacgtccggctgaattaggcgagatgatcggcgattttcttcatttgctggcggatggcgcgttcttttccgggactattcccccgtggctggcagaagaaaatacgatcgccaatattcaggggttgattgaggagcagcgcaacgcgacgggcatcgttccggggagtcgccatctggtcctcgaacggtgccgtgatgaaattggtgactggcgtattattttgcactctccctatggaagacgggtgcatgaaccctgggcggtggcgattgccgggcgaatacatgcgctatggggcgctgacgcgtcggtggtcgccagtgatgacggcattgttgcacgtattcctgacaccgatggtaaattgcccgatgccgcgatttttttgtttgaaccagaaaagttgctgcaaattgtccgcgaggcggtaggcagctcggcacttttcgccgcccgttttcgcgaatgcgccgcgcgggcattattaatgccggggcgcactccgggccatcgcaccccgctttggcaacaacggctgcgcgccagtcagttgctggaaatcgctcagggatatccggattttccggtcattctcgaaaccctacgcgaatgtctgcaagatgtttatgatcttcccgcactggaacgtttgatgcgtcgcctgaacggtggcgaaattcaaatatccgatgtaacgaccactacgccctcgcctttcgccacaagtttattgttcggctatgtcgcggaatttatgtaccagagcgacgccccgctggcagagcgccgggcatccgtactgtcgctggacagcgagttactgcgcaatctactcggacaggtcgatccgggggaattactcgacccgcaggtcattcgccaggtggaagaagagttgcaacgactggctcctggcagaagagcgaaaggtgaagaaggattgttcgacctgctgcgcgaactggggccaatgaccgttgaagacctggcgcaacggcatacaggcagcagtgaagaggttgcgtcgtatctggaaaatcttcttgcagtaaaacgaatcttcccagcgatgattagcggacaggagcgtcttgcctgtatggatgatgccgccaggctgcgtgatgccctcggcgtacgactaccagagtcattgccagagatttatttacatagagtcagttacccgcttcgcgacctctttctgcgctatctccgggctcatgctctggtcacggctgaacaactggctcatgagtttagtctcggtattgccattgtcgaagagcagcttcagcaactgcgtgaacagggtctggtgatgaatctgcaacaagacatctgggtgagcgatgaagtatttcgtcgtctgcgtttgcgctcgctgcaagccgccagagaagcgacgcgtcccgttgcagccacgacctatgcgcgattgctgctggaacgtcagggcgtattacccgccaccgatggtagcccggcgctctttgcctcaacatcgccaggcgtttatgagggcgtagatggcgtgatgcgggtgatcgaacagcttgccggagtcggtttacccgcctcactctgggaaagccagatcctgcctgcccgcgtacgcgactattcgtcagaaatgctcgatgaattactggcaaccggtgcggttatctggtcggggcaaaaaaaactgggtgaagatgacggcctggtggcactgcatctacaggaatatgctgcagaatcgttcactcccgccgaagcggatcaggcgaatcgttcggcgctgcaacaagcgatagtcgctgttctggctgacggaggagcctggtttgcacaacaaatcagccaacggatacgcgacaaaatcggcgaatcggttgatctctctgccctgcaagaggcgttatgggcgctggtctggcaaggcgtcatcaccagcgacatttgggcaccgttacgcgccctcacccgcagcagttccaacgcacgcacctcaactcgccgcagtcaccgggctcgtcgtggacgtcctgtctatgcgcaacccgtctcgccgcgggtatcttacaacacaccaaatctggctggacgctggtcgttattgcaggtggagccactaaacgataccgaaaggatgctggcgctggcggaaaatatgctcgaccgctacggcatcatcagtcgtcaggcggtgatagccgaaaatatccctggcgggtttccatcgatgcaaacgctttgtcgaagtatggaagactccgggcgaattatgcgaggtcgttttgtagaaggtctgggtggcgcgcaattcgctgaacgtctgactattgaccgattgcgcgatctggcgacacaagccacgcaaacgcgccactatacaccagtggcgctctctgccaacgatccggctaatgtgtggggaaatcttctgccctggcctgcacatccggcaacgctggttccaacgcgtcgggcgggtgcgctggtggtcgtttctggcggcaaattgttactctatctggcgcaaggtggcaaaaaaatgctggtctggcaggaaaaagaggaattactcgccccagaggttttccacgcgctgactaccgcactgcgtcgcgaaccacggctgcgctttacgctaacagaagtgaatgatctaccggtccggcaaacgccgatgtttacgctgctgcgtgaggcgggattttcaagttcgccacaagggctggattggggatagagaaaggactgacggatgcccgttcgcatccgtcagtattgcaggacggattattccgcgtccggctcttcagacttgtatttagcggcagtttctttgatcagctgctgcagttcgccacgctgatacatttcgatcacgatatcacaaccgccgaccagctcgccgtcaacccacagttgcgggaaggtcggccagttagcatatttcggcagttccgcacgaatgtccggattctgcagaatatcaacataggcaaaacgttcgccacatgcggcaagcgcctggactgcctgggcagagaaaccgcagctcggcagtttcggtgaacctttcatgtacagcaggatcgggttttcagcaatctggcgttggattttttcgatagtggtgctcattgtcttgcttcctcaaacttctttacggcagtaatctgacattgtagcgggtcagtgcggcatcggaaaataacattttcatcacgcttttgctattttatccctttgctctatttgttgcatttcaaatattcgtttcttctctgatgccggcaaactggcgtatttataaccatttttagctttcactgctgcatttttttgcgctcgccaacgaaacgtattttttaacaataaaagctattaactttctcttcttctatgcattagaatcatcaagttttgtaaatcagacgcaggcatgatagacctgcctttacagagggacgctcagtggcgcggataaaccgtatttcgatcacgctctgtgctttactttttaccaccctgcctttaacgcctatggcccatgcttcaaagcaagccagggagagttctgctaccactcatatcaccaaaaaagcagataaaaagaaaagcacggcaaccaccaaaaagacccagaaaacagcgaaaaaagccgccagtaaaagtacgaccaaaagcaaaaccgcttcttccgttaaaaaatcttccattaccgcttctaaaaacgccaaaactcgcagcaaacacgccgtcaataaaacggcctcagccagctttaccgaaaagtgtaccaaacgtaagggctataaatcgcattgtgtgaaagtcaaaaatgccgcgtcaggaactcttgccgacgcgcacaaagcgaaggtgcaaaaagctacgaaagtggcaatgaataaactgatgcagcaaattggtaagccatatcgttggggtggcagctcaccgcgtaccggttttgattgcagcggcctggtttattacgcttataaagatttggtgaaaattcgtattccgcgtacggcgaatgaaatgtatcacctgcgtgatgcagcgccaatcgaacgtagtgaactgaaaaacggcgacctggtctttttccgtactcagggacgcggcacagccgatcatgtcggcgtgtatgtcggcaacggcaaatttattcagtcaccgcgcacaggtcaggaaattcaaatcacttctctcagtgaagactactggcagcgccactatgttggcgctcgtcgggtaatgaccccaaaaacacttcgctaaaactttaccctgttgttacggcaacagggtaagttcatcttttgtctcaccttttaatttgctaccctatccatacgcacaataaggctattgtacgtatgcaaattaataataaaggagagtagcaatgtcattcgaattacctgcactaccatatgctaaagatgctctggcaccgcacatttctgcggaaaccatcgagtatcactacggcaagcaccatcagacttatgtcactaacctgaacaacctgattaaaggtaccgcgtttgaaggtaaatcactggaagagattattcgcagctctgaaggtggcgtattcaacaacgcagctcaggtctggaaccatactttctactggaactgcctggcaccgaacgccggtggcgaaccgactggaaaagtcgctgaagctatcgccgcatcttttggcagctttgccgatttcaaagcgcagtttactgatgcagcgatcaaaaactttggttctggctggacctggctggtgaaaaacagcgatggcaaactggctatcgtttcaacctctaacgcgggtactccgctgaccaccgatgcgactccgctgctgaccgttgatgtctgggaacacgcttattacatcgactatcgcaatgcacgtcctggctatctggagcacttctgggcgctggtgaactgggaattcgtagcgaaaaatctcgctgcataataactgatggcaaatgcagcattgcctgaagcgctacgcttatcaggcctacgcggatcatcgatgtaggtcggataaggcactcgccgcatccggcaagataaatcgcacgttgtcagcaactgtaacgcagaaggttatccttctgcgtttttgtttaattagctgttagcaacgcaaactgtttcaggttgttttctggctgacataaacaccagcaataatgccagtcccgcgacaatcgctcccatcaccggcacaaagctgtatcccagcccagcggaaattaccgcaccaccagcagctgctcccagcgcatttccaagattaaaggcaccaatattgactgatgaagacagacctggcgcttcactggcgacacgcatcacgcgcatctgtaacggcggtacgaccgcaaaggttgctgcgccccacaccaccatgctaatagctgcgccgaactcattgcgggccaggaacgggattgccagcataatcaccatcaacaacaacaaaaagcctttcaacgtgccgttaactgaacgatctgccagtttgccgccgagatagttaccgatagagaatccgacaccaatcagcaccagcattgccgtgacgaacaccggtgttgcgtgggtaatactttgcagtaccggagagatataggtgtagagagtaaacattgcaccagctcccagtaccgtcgtcagcaatgcagacagcacctgcggacgcattaataccgccagctcttttttcacttcaggtcgtgcccctgcaccacctttaggtaatgagaagaacagacttaccattgaaatcactcccagccccgccgttgccagaaatgacatccgccagccgatggtttcacccaaccaggtcgccgccggcacgccaccgatatttgccagggttaaccccataaacatagtggcaactgcgctggcctgtttatgttttggcaccacgcttgcggccacgactgaacccaaaccaaaaaatgctccgtgattcaggctggtcaaaatgcgtgaaagcatcagggtcatataatccggcgcgatggcggaaagtacgttgccgagcgtgaaaattgccatcaggaaaatcaacgcactgcggcgggcacgatgagaaagtagaagcgtcatcagcggcgcgccaaccattacgccaactgcataggcactgattaacattccggcagcgggaatcgagacatccacaccgcgcgcaatgacgggcaacaagcccattggcgagaactccgttgtcccgataccaaacgcgccaatcgccagcgccagcaacggatagttaattttcatgccttatctccacctcttcgcgtcattacgcgatattcattaaagtggcgaaagcatgacagcaatcacaaaaaaatgaaaataacaaaaagagaaaacacttttgccattttgctaacaaacaggaaggagatgcgagggagaacgcgctccctcgagaggaaatcagtgcagcgcggcagtcaaacccacggctacgatcaaaccgaggacgataatcgttgttaccagtgaaaatttaaggtcggtgctcatcaagttttctccttttttattaccacacaaaaagtgatattacgcatttttacacactgtgatgaaaaaatctcccgtcatttataatgataagtgtttttaccacttccccttttcgtcaagatcggccaaaattccacgcttacactatttgcgtactggccattgaccccttcctgacgctccgtgtcgtttttccggcgtaccgcaacacttttgttgtgcgtaaggtgtgtaaaggcaaacgtttaccttgcgattttgcaggagctgaagttagggtctggagtgaaatggaatggcaacaataaaagatgtagcgaaacgagcaaacgtttccactacaactgtgtcacacgtgatcaacaaaacacgtttcgtcgctgaagaaacgcgcaacgccgtgtgggcagcgattaaagaattacactactcccctagcgcggtggcgcgtagcctgaaggttaaccacaccaagtctatcggtttgctggcgaccagcagcgaagcggcctattttgccgagatcattgaagcagttgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtcatggactggggtgaagcaaaagctgacttcaccgatgcggtcattgataacgcgttcgaaggcggctacatggccgggcgttatctgattgaacgcggtcaccgcgaaatcggcgtcatccccggcccgctggaacgtaacaccggcgcaggccgccttgccggttttatgaaggcgatggaagaagcgatgatcaaggtgccggaaagctggattgtgcagggtgactttgaacctgaatccggttatcgcgccatgcagcaaatcctgtcgcagccgcatcgccctactgccgtcttctgtggtggcgatatcatggcaatgggcgcactttgtgctgctgatgaaatgggcctgcgcgtcccgcaggatgtttcgctgatcggttatgataacgtgcgcaacgcgcgctattttacgccggcgctgaccacgatccatcagccaaaagattcgctgggtgaaacagcgttcaacatgctgttggatcgtatcgtcaacaaacgtgaagaaccgcagtctattgaagtgcatccgcgcttgattgaacgccgctccgtggctgacggcccgttccgcgactatcgtcgttaatcacccgttgcgggagtctcttccggctcccgcagccactccttattcagcgtctcactatcgccgagatactcaagcaaccaggttaacgcaggcgacatatcattttgctgccatgtcagacaacatgccgaatccggaaaggggttttccagttctaatgctacccacttcccctcattaagccacggtttggcgaaatgtgttggcaccatccctatgcataatcctgccgagatacaggttgccgatgattcccagtcaggcacgacaactcttttttggttatccagcaaccaggtaatacgtttaggtagcgttcgcgaggtgtcttcgcgcaccaacgacggccagttgcgcaacgtatcatcgctgaacgggccatccatcaacgccagcgggtggtgactggcaacaacgcaactccagcttagcatccccatatcccggaaggcataacgaccgcctaccggaatcgcgcgtgttgcgccaatcgccagttccacgcgcccgtcggaaagcgcatcccagacaccgttgaacacttcctgaaagacaagaagttcgacatcatcaaaatggcgataaaaatcaacgatcatctgccgtgtacgttctggcctgacaatattatccactgcgatagctaactgaccgcgccagccgttcgctatctgctgacattgctggcgggtgatctgcatttttttgacaacagagcgcccttctttgagaaaccacgctccagcagcggtcagctccacatcacggtgccgtcgttcaaagagcggcaccgccagccactcttccagctgacgcacggtatagctgaccgcagaaggaacgcgatgcagctcctgtgccgcagcgctaaaactaccattacgcgctaccgcatcaacaacttcgagtgaatattctgaccacatagtctgcctgcaaaatttttgaaaccagtcatcaaatattaccgtttcacaacactaatttcactccctacactttgcggcggtgtttaattgagagatttagagaatatacatgcaacctgggaaaagatttttagtctggctggcgggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccgctctccgaccgttatggtcgtaaaccggtattattaatcggcctgacaatttttgcgttaggtagtctggggatgctgtgggtagaaaacgccgctacgctgctggtattgcgttttgtacaggctgtgggtgtctgcgccgcggcggttatctggcaagcattagtgacagattattatccttcacagaaagttaaccgtatttttgcggccatcatgccgctggtgggtctatctccggcactggctcctctgttaggaagctggctgctggtccatttttcctggcaggcgattttcgccaccctgtttgccattaccgtggtgctgattctgcctattttctggctcaaacccacgacgaaggcccgtaacaatagtcaggatggtctgacctttaccgacctgctacgttctaaaacctatcgcggcaacgtgctgatatacgcagcctgttcagccagtttttttgcatggctgaccggttcaccgttcatccttagtgaaatgggctacagcccggcagttattggtttaagttatgtcccgcaaactatcgcgtttctgattggtggttatggctgtcgcgccgcgctgcagaaatggcaaggcaagcagttattaccgtggttgctggtgctgtttgctgtcagcgtcattgcgacctgggctgcgggcttcattagccatgtgtcgctggtcgaaatcctgatcccattctgtgtgatggcgattgccaatggcgcgatctaccctattgttgtcgcccaggcgctgcgtcccttcccacacgcaactggtcgcgccgcagcgttgcagaacactcttcaactgggtctgtgcttcctcgcaagtctggtagtttcctggctgatcagtatcagcacgccattgctcaccaccaccagcgtgatgttatcaacagtagtgctggtcgcgctgggttacatgatgcaacgttgtgaagaagttggctgccagaatcatggcaatgccgaagtcgctcatagcgaatcacactgatctatatcgatatacttatacttaggctgctaacaaaattttgttgtatgattgaaattagcggcctatactaatttcgagttgttaaagctacgataaatattatgtttttacggggacaggatcgttcccgactcactatggatagtcatttcggcaagggttcctcctttccctctgttctacgtcggattatagactcgcggttttttctgcgagatttctcacaaagcccaaaaagcgtctacgctgttttaaggttctgatcaccgaccagtgatggagaaactatgagttcatcgtgtatagaagaagtcagtgtaccggatgacaactggtaccgtatcgccaacgaattacttagccgtgccggtatagccattaacggttctgccccggcggatattcgtgtgaaaaaccccgatttttttaaacgcgttctgcaagaaggctctttggggttaggcgaaagttatatggatggctggtgggaatgtgaccgactggatatgttttttagcaaagtcttacgcgcaggtctcgagaaccaactcccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgcgcttactggaaagatgccgataatctggaatctgcccagcaggcgaagctcaaaatgatttgtgaaaaattgcagttaaaaccagggatgcgcgtactggatattggctgcggctggggcggactggcacactacatggcatctaattatgacgtaagcgtggtgggcgtcaccatttctgccgaacagcaaaaaatggctcaggaacgctgtgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggcatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactatagtgaacgctttaaacgaatgtttacctattatctgaatgcctgtgcaggtgctttccgcgcccgtgatattcagctctggcaggtcgtgttctcacgcggtgttgaaaacggccttcgagtggctcgctaaaggctattctatcgccccctctccgggggcgatttcagatcaggcttctgtgcctggttgattcatggcattttctcgtgccgccagcacacgttctaccgtatctaccactgcctgagtttgtggatcgatttcaatgttgacgcgtgcgccaagttttttcttcccaagagtcgtgcgttccagtgtttccggaattaaatggacgcaaaaacgcgttggcgtgacttcgccgacggtcaggctaataccgtcgatgccaataaatcctttgtacagaatatatttcatcaactgactatcctggactttaaaccagatctggcgattattttctgaggttaatattttcgccacttcagcagtggtcataatatgacctgacattaagtgtccgccaatttcatcactgaatttcgccgcacgctcaacgtttacccaatcccccacttttaaatcgccaagattggtaatgcgtaacgtttctttcatcaggtcaaaactgacatggttgccgttaatttccgtcacggtcaggcagcaaccgttatgcgccacggaagcaccggtttccaggccgtccagcatgtggtcgggtaactccaccacatgcgtacgaaaatttggtttctcgtcaatcgacaccagttttgcggtgccctgtacaatccccgtaaacatacttacaactcctgaaatcagttaagacattctgttcagcacaatagcaggtggaaaacgcccttaccagtgaaggggtaagaatggctattttttcactggagaattaataaatcctcgctacaatagactgaatttcccctgcttcttctttttgctgcccattcaggcggctttttagtctctcatataactacaaataaaaggtgttcacgtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcaggttttgtttccgttctcattatgctggtgctgtggaatgcaggttacattatccgctccatggaaaacatcgatccggctctggcggacaaagccgtgggttatctgcgtgcgttgttgtggggcgcgccgggatatctgttcttccaggttgcccgtaaccagtgtgaaggtctggcaaaaaccaagccgggtatggtaatgggctttatcggcctgctggtgaacatcccggtgaactatatctttatttatggtcatttcggtatgcctgagctcggtggcgttggttgtggcgtggctactgcggcggtgtattgggtcatgttccttgccatggtttcttacattaaacgcgcccgctccatgcgcgatattcgtaacgaaaaaggcaccgcaaaacccgatcctgcggttatgaaacgactgattcaactcggtttgccgattgcgctggcactgttctttgaagtgacactgtttgccgtcgtggctctgttagtgtctccgctcggtattgttgatgtcgcaggacaccagattgccctgaactttagttcactaatgttcgtgcttccaatgtcgctggcggcagcggtaactatccgcgtaggttatcgtctgggtcagggctcaacgctggatgcgcaaaccgctgcgcggaccgggcttatggtgggtgtctgtatggcaaccctgacggccattttcacggtttcactgcgggagcaaatcgccctgttgtacaacgacaatcccgaggttgtaacgctggctgcgcatttgatgttgctggcggcggtatatcagatttctgactcaatccaggtgattggcagtgggattttgcgtggttataaagatacgcgttccattttctatattacctttacggcttactgggtgctgggcttgccaagcggctatattctggcactgaccgatctggtcgttgaacctatggggccagcaggcttctggataggctttattattggcctgacgtcggcagccattatgatgatgttgcgtatgcggttcctgcaacgtctgccgtcagccatcattctgcaacgagcatcccgctaataaagacaaggcgcaaccttcacgggttgcgcctgtatttttacgcaggctggagcgttgcgccaatcccgtcttcgtctggctgtaatttcagagcgttacacagagtttgccgactggcatctgttatctcaacgtgtatatccccggtaacttcccctttcacattgatgaagtcaggtgaaatttcttttgcactggtttgcaggcaaatcgctccctctccgcgcaggcgtttcactttcagttgcacatgcgttgccgcatcagtgatcagccacagttttccaccattcagattgatgttaccaacaatgaaagtgacactgtcaccttttaccgtactgccgtctagaatcaacacaccgccctgctgtacagtaatcgttgattgttgcagctctgcgccataaccaataatcattgaagcgccgtccagtaatgcaacactcccggtcagttcaaccggtgcgcgatcttcctctacgacaaaattttcgtccgcgctggtgggtgacaacaggatcactgtcccaccttgtattaccgcgttttccagcgtaccggcatgcacttcagcccgaccacccacattcacggacaggttttgcgtcttaccggaactgtagagctgaaggccatccgtccccagacgataaatggatccattctcaacaatagtgtcagagtcttcaccaccgagattattcatggtgccaccagcaagcaacgtatcactggctttcccggccagcataaaaacgccgccctgattaatctcacaattgctggcttccccacctggatacaccaacaattcaccaccttcatctaccacgaccgctgaggttgtcccattaaccaacaggccgccctcttgatcgagaatgattttttccgcgcgatgtccttccagtacacgcaggttaccgccattttccagcaacaaaccgcaggcataacctttatcaacgctgaattcaccttcgggatggcggccattaaccgtagcgagcgtagagagactaattgcgcctccctcggactgaacaatatctgtggcaatggcaccatcgctgaccgatagcgtgccattgttaccgtactgtgtgcatttggcgatcccaccggttgccactttcaaccagccagcccccgtgaccacggtattttcggctcttccgccagcttcaacaatcaactcgccttcagtaagttgcgtcgcgccaatgacctcgccggtcttaacaatttgcacgttcccgtcgctcatcaagtttttcgcatcagatcccatgatttattcctttgctgcatctgtgtgcctttattgctacctaagtgtaaaggctacggaggatttatccacgacagatttgagatggtggcaaacaactctgtttaaactctgatacacgaattattgggttgtatcagatgtaaatgcgatcctgaataaaaatcacccttgcaaatcaacaaaatatagccaatttgcttaaaagctctgcaaacggtcgaaatagcgcagaaaattacgttttgcctcttgccaccttcccactctgccgctaatattcgtccccgttgtcacctacaacgttgcgttcatagctcagttggttagagcaccaccttgacatggtgggggtcgttggttcgagtccaattgaacgcaccatcctgcgtccgtagctcagttggttagagcaccaccttgacatggtgggggtcggtggttcgagtccactcggacgcaccagattttcttaatctggtcttctcctttttccctctgtttcttctctgtatccaatacgttaaaagatttacactgtcttcgtatgcgttatcagaaggagaatcgctatggcaactttgttacaacttcattttgcttttaatggcccatttggcgacgcaatggctgagcagcttaaaccacttgctgagtcgattaatcaggaacctggttttctgtggaaggtatggacagaaagtgaaaagaaccacgaagccggtgggatctaccttttcactgatgaaaaaagcgcccttgcctatctggaaaaacatactgcccgactgaaaaatctcggcgttgaggaagttgtcgccaaagttttcgatgtcaatgagccacttagtcaaatcaatcaggcaaaactcgcctgacagaatttaatcaagggcggttagcgcccttttcatccctgtctgaaatttctcaaattctaaaaatctcaaccaaacttatctgataacactaaattcgaaagaatgcgtacaggtaagtaacaatgaaaaaaattgctattgtgggtgccgggcctacggggatctacaccttattctcgcttctacagcaacaaactccactttctatttctatcttcgagcaggctgacgaggccggtgtcgggatgccatacagtgatgaggaaaactcaaaaatgatgctggcaaatattgccagtattgaaataccgccgatttattgtacgtatctcgaatggctacaaaagcaagaagacagccatctccagcgttatggcgttaaaaaagaaaccttgcacgatcgtcagtttttaccgcgaattctgctgggcgaatatttccgcgatcaatttttacgactagtagaccaggcacgacagcaaaaatttgcagtggctgtttatgaatcatgccaggttaccgatctgcaaattacaaatgctggcgtcatgctcgctacaaatcaggatttacccagcgagacgtttgatttagcggtgatcgccacgggtcacgtctggcctgatgaagaagaagcaacccgaacgtattttcccagcccgtggtcaggcctgatggaagcaaaggtcgatgcgtgtaacgtgggtattatgggaacatccttgagcggactggatgcggcaatggcagtggctattcagcatggttcgttcattgaagatgataaacaacacgtcgtttttcaccgcgataacgcaagtgaaaagctaaatatcacgttgttgtcgcgcacgggtattttacccgaagccgatttctattgccctattccctacgagcccttacacatcgtcaccgatcaggcattaaatgctgagattcaaaaaggcgaagagggccttttggatcgggtatttagattgatagtagaggaaatcaagtttgctgatccagactggagtcaacgcatagccttagagagcctgaatgtcgattcctttgctcaagcctggtttgccgagcgcaaacaacgcgacccatttgactgggcagaaaaaaatctccaggaagtcgaacgcaataaacgagaaaaacatactgttccctggcgttatgtcattctgcgcctgcatgaagccgtacaggaaattgttccacatctgaatgaacacgaccataaacggttcagtaaaggccttgcccgggttttcatcgataattatgcggcaatcccttcagagtctattcgtcgcctacttgccttacgtgaagcgggaatcattcatattctcgccctcggtgaagactacaaaatggaaattaatgagtcgcgcaccgtcctgaaaacggaagacaacagctactcgtttgacgtttttattgatgcccgcggacaacgtccgcttaaagtgaaagatatccctttccctgggctacgcgagcaattacagaaaacaggggatgaaatccctgatgttggcgaagattatacgttacagcaacccgaagatattcgtgggcgcgtagcgttcggcgcgttgccctggttgatgcacgaccagcctttcgttcagggacttacggcatgtgcagaaattggtgaggcgatggctcgggcggtcgtaaagcctgcatcccgtgctcgtcggcgtctttcgtttgattaaaggtaaagctatcagcactcaacaaactgatgctgttcattaagacgatagcggactccggctcgaatattgttttcaccttcaatggcgacggcgaagcgaactctttcgccgtcatgatatgccagtgcggcgcttcctcctggcccgagaataattgagtcgaccacgcccgtgctcactaccgttgaattttcaccgctggcaatgatgtgtacattgtcgccgctgttggcaattctggcgtttgcgccaaagctggcgatttgcaccaggtcaccattactggcgacatgacaccgttcacccaatgtacaaacgcgtactcgcattccggtattcgcaatccgactgctatctccagcgctgcttatccgcgaagaattaccggttacagcaacccgtgcgcgttcaccggagctgccaatgtgactgttaaagccgacacttccaatccgcacgctataacccatactggcaatttgcgcggcatacccagcggttgcgattctggcgttatcctcacaacagccgatgcgagcatgatcgtcgctgcgggcaaactgactgcaaaatggtctctctccggggtctgtggccagtttttgcatagaggaaacttcctgatgcgcgaagttttcatccgccagccattttttccacgcatactcaaccagactctccgcccagtccgtatatccttcctcaatcagtgcatgatgaatatcggcataactaccgccgcgtgggaaatggcgcaggaaccagcgatacatcaccgctccgatacgccattctcgcaggtctgcttgtgtaatgatcattcgttagtgccggtgatagccatcgaccatgcttttaaaggtttcgtgtggcgtacgccccgtggtgcaaagataaagatgaccgaagataaaaaagaggcttataaatgccagagcaaaatgtgtctgcaataaccagtatcttacgccaggaaacacatctcccacggcttgcggatagagacacagcagccccgtcaatagtaacaacggcagcaatccatacatgacaccaacataggcgacctgctgtaagggattaaatttagactgggttgttgccgggaaaggatgttcttccccctgcataatgccaaacaaataaaatcgcgtttgttttgccgctcgttccagccacccctgacgacgaatgcgatagtggtgaccattatccccaacggcattgatcagcacaaagccgagccagcatgccagtaacaaaaatccgcaaacttcatgcaccgcaaccagacttttaaccgcagttgcgcccaccatcgcaaagtgatttatcagcccactggccagcaacaatacaaagagtaacgcattcgaccagtgccataatctgaccgctttgctgtaaagataaatcttctcaccatgatcggtggctgatttcttcacgccacgagcacgaagcaaggcatgcagccccagcaccaaccacatcccaaccagcaatactccggcaatgatcaaccacaccggccaaaattcgggagtgaactgtggcacatagttcgctaactggctctgaaactgttcagcatgttgcgacgggttcatacattttcctttttaatcaaatgttgaccgaaccggcgatacagatgcggtttcccggcaccaggtagctgatattgatagtatttattttgctgcaaccacgcctgaatttctgggctatcttcgcgaccaaagatcaatgcgtgttccgggcaggcgctgacgcaaatgggcggaaagccttttgccagtcgggactcagcgcagaaatcacatttatctgccactttagtgacagggttaaggtagcgaacctggtacggacaagcgccaatgcaataactgcagccgatgcactgcgatttttctacccgcacgatcccctgctcatcacgccacgacgcccccgtcgggcaaacgtcgatgcacggagcatcttcgcagtgctgacatgactggcgaaaaaagtgatactgcgtttcgttgtcgttatcggtgactggaatgtgtgctatcgataaacggcttccctgagcggggacgtggttagttttacggcatgcgcgggcgcaaatattacagccattgcaccgtgactcgtcatgaatcatggcataccgaacttccttttcttgcctcgtgttcgctaacagagaagacgcagaaccagtaaaaaagattactgttcccatccccagaacaaatttgcgtcgagtgaaggacatctgattatcccctaatgcagtggctgcaactgtccaccctatccatgacatctccctgaaatttcaggggttctgaaactgctctacctcgaaccattcgcataagccataagccttgccataggtcataaatcgctcgctaaacaagtacaacaccgccgtcgatgactccacctgccgtatatcggcatattcaggtgcaacatccatcgcggcgatcgcggcttcaatctgcgcttcctggaagtaatatggcgcttgcatcagcatggcgactttgtaaggacgaggatacgtctggcactcaaaacgaacggcgtgtgcaatggcgcgacaaatgtcctgctccacaacttgcaaagacatcgccgcgtagttttcactcatggcctgcgttgagtaatagtaatcatccttgcttcccgtcaaacaagcgatatccgcgtagtctccgttctgcttaatgctttccagcaaaactgacagttcctcttctgcaaccaaatagggtggcgagagaaacacggcgcgcgccaccagctgcccagccgcagaatgctggcgaatgaactcagccaggatttcagcaggttctggttcggttaccgtatcaacggggtgacgcatcccctgcaaccattgccgcttcgcctcgtcaacttcgctgactttcgctaacggcaattcatcctgatggttcatcttacccattccttacgcaggcagtagattgtgtgctgccagatcggcggcaatatcttccagccccagacgctgcaatgtttcgcgggttggacaaccaagctgtgggtcccagcccatttctttgtagaacatcgtgagcgaagcatgcatatcgtcacgatccattttgtcagtaccttcagtaaagaccgggatctgcggatccttgtcgaatacccaggaacagataagatcgtgttcattacgcatatctttggtttgcatcagttttaccgtgtaggcacgatgcaacgtaaaaatacgctctgcagctaaatctaatttttcctgagtcatctcttcgccggtgatcgctttgaagaatttggcttcaagcgccagatcgccccggtaattacggcttttcagcggcgaaacggtcattggccagacccagttgcacagggtgacggcgttatgcaaacagacccgcaacagcgaccactttgcatatttaatttttgcgtcattgattggcgtgtagtttttggtttcatcgtaagcatcttcagaaccaaaaagttctttcgccacttcacgttgcagtttcaatggcaagccggaaccaataaagttgatatgggtatgcgtcatgcagtcacggttgaacatacagttaacaatggaaccgacctgcgctgacgcttcattggcatggtgaaccggatagccaaacggcgaccagagtttatttttcgcgtagccccagtactcttcacccaaattccagcgttctgcgatggcatatgaaccatcagccaggtgactcagctcacccacacgatgcgccagacggtagtaaaaatctttaatgaagttaacgtcacccgcttccagttgatcccagcgaatttctgcatactcttcagctggcagaacacgcttgaacacacctttgctgtaacaataagtaaagtcgcgatgcaactgcccgtagttacaccataggccgtagtcatcgaacaaattcagacccaccaggttaccaatcacacgaccatcgtctttatcttcaaaatctttcggcccgttcgggaagatggtggtatggacaaagtttgctacacaagtgttaccacctgtgctgggcacgccaaactctttcacccgaggaatattcatttgggtcatacaacggatcgggcaagagtggcagccgctcatttttactgtgtatttctctgccgccggtcctaagtcaaaaacggatttataggtacgaaagccgaccgtattctgattgcctggcggaatttcacccgtttcaatcggaccaccttcagccgcgccccaaaacagccctttacgtgctgtccagcgtgacttgggatctgaatactctgcccacgattgtggcgtacttggcacgacatggttgttattcgcaccaataagttcagtcatcatgtaatcattgagacgcttcatctcctgacgatcggcaatgttgacccctttcgtcccttcaaccgcaatcgctttcaggtttttcgaacccattattgcgccagttcccgcaccgccgctgtggttacggctattcaacatgccagagagaggaacaaggttttccccagcctgaccaatagccgccacacaggtttccggactggtcaatcgacaaatttcttccgtcgttgcgcgcgtcccttttccccataagaaatcggctttttccaggctaactttgtcatctttaatcttcagccataccggtgatttcgccttcccttcgataataatgacgtcgtatccagcgaatttcatttgcgctgcaaaaaagccacccatatgggcatcgacgactaaatttcctttggtaaaagtagaaagtgaggtgatatttacgcgagaactacagggggcaccagatccagttaatgggccggtagcaaagactaatttattcgcttcatcgaaaggtttcgtgcctggcggtacttcgtcatacataattttgtagccgaagcccatgccaccgacaaaacttttaaacttactggaatcttcgagggtaatatttcctgtcgtgagattgactcttaatatattacctgtccaaccgttagccatgattttttcctttgcaagattcacacagtaatatctttccactcgataatttttaacgcccctgttgggcaggcgtttgcgcattcaccgcataacacacatttcgaggattttttactttcggtatttacggtggccatcatccacgggcatgccgtagtacaggcgctacagccaatacagcgtttatgatcgacggtaatacagccttctttctgctgccaggtaatcgcaccaatcgggcagacgttcatgcattgcggctctttgcattgacggcaggtgtccgcggtatagttgagatcgccatacaggccgccgccagagccaaccccgttgtcgccaaagaaataattgcgatggattttgatacgggagaagaatgtccctactgagccatcgttgaagttggtacaagagatttcacagcggtggcaacccgtgcatcgcgctcgctgggtcaccagcacccctttgggggtatttatcaaccctactgtgccgctatcaatatcttcctgtttgcaacccaaaagtgacagtaacgcaggggcaattgttagaccagcaaggccttttcctgatatacgcaagaattctaatcgcgttaagccaatatctaatagtggacgatcaaccgggttcatttatttcgcatcctcttcgcaaacacagtgctgacaattcagcagcctgatattaagcattcaactaatacgctgctgactctgtccccaacaccagatattttccctaacccgatagtgtatgagaaaagattaacgccgataaactaatcctttatggttaggagaaaaaataatgtgattattctgagcccttaacattgatcgttatcaattaaaattacaaagcaagaaattataagtgaactgatatttattatcatttgaaataaatttaacttaagcgacaattatttgtgactttcattgcagaaaataaaaataacattatcgctataaattaaaatacataccgaaattcgtataatttcagcagttgttatttagaatgattaactggaccgcaactgaagcaagaatatcaggatgaagcttaccgcctcatcctgaatggtcattttaccagtgcgttaatgacggtttccatcgcctgcttttccagctcactgcgctgaatgcgtttattggctaatgctgtacgtaatacgcctgcgataacaatatgctttggttcctgccccagatcgcgcatttccagcacaactttaccgacaactctgcacatttctcggtacagttcatcctcttttgtccgatttcccattctttatacctatttatcatgccaactatcagcatatatcaatctaaccaattaaacaaaaatcaaacaaaatcagacaaataacgcgataaattattttaactgtagcaattgagcgatgatatatttatacaccggatgaactttcacttatcctcacactgacaacttcggcaccagacgttgcgcaaacagtgaagtttttgcgtaaccttttccctggaacgttaaatctttgataacaatttattgtctaacaagttgtatattttttgaaacgctgtttttgttttccttttggattaatttcagcgtataatgcgcgccaattgactcttgaatggtttcagcactttggactgtagaactcaacgactcaaaaacaggcactcacgttgggctgagacacaagcacacattcctctgcacgctttttcgatgtcacctatccttagagcgaggcaccaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaatattgcttttgtgaattaatttgtatatcgaagcgccctgatgggcgctttttttatttaatcgataaccagaagcaataaaaaatcaaatcggatttcactatataatctcactttatctaagatgaatccgatggaagcatcctgttttctctcaatttttttatctaaaacccagcgttcgatgcttctttgagcgaacgatcaaaaataagtgccttcccatcaaaaaaatattctcaacataaaaaactttgtgtaatacttgtaacgctacatggagattaactcaatctagagggtattaataatgaaagctactaaactggtactgggcgcggtaatcctgggttctactctgctggcaggttgctccagcaacgctaaaatcgatcagctgtcttctgacgttcagactctgaacgctaaagttgaccagctgagcaacgacgtgaacgcaatgcgttccgacgttcaggctgctaaagatgacgcagctcgtgctaaccagcgtctggacaacatggctactaaataccgcaagtaatagtacctgtgaagtgaaaaatggcgcacattgtgcgccattttttttgtctgccgtttaccgctactgcgtcacgcgtaacatattcccttgctctggttcaccattctgcgctgactctactgaaggcgcattgctggctgcgggagttgctccactgctcaccgaaaccggataccctgcccgacgatacaacgctttatcgactaacttctgatctacagccttattgtctttaaattgcgtaaagcctgctggcagtgtgtatggcattgtctgaacgttctgctgttcttctgccgatagtggtcgatgtacttcaacataacgcatcccgttaggctccacggaatatttcaccggttcgttgatcactttcaccggcgttcccgtccgcacgctggagaacaaggctttaatatccggtgcattcatgcgaatacaccctgaactgacgcgcaaaccgacgctgtccggcgcactggtaccatgaatgaggtattcgccattaccatgcgcgaggcgcagtgcgtaacgtcctagcgggttatttggtccggcaggaacgactggcggtaatttaatgccacgctccagcgaacgctgacgaatgcctgccgtaggcgtccaggttgggttagggattttctgcccaacacgcgtttccatcaccggcgtttccagcccctgcaatccaatacctattggataaacctgcacaatattttctcccggcggataataataaaggcgcagctctgcaaggttaacgataatcccctgacgcggtgcatcaggtaataacagttgtgaaggaatagttatcgtcgtaccaggttttggcaccggggcgatagtgttattggcttcaaggatcaacattgccgcagtatcaaaacgtcgggcaatagcctgaaggtttttatccccttcttgcaccgtatacgtttgattttgcccaaccagtcggcttccggttggtggtagcggataatcaaccgcccaggcagcctggatggcgctaaaagcgccgataagcgtgagtgtaagcaaagacgcgcgtttcattgtaaacctcctgtatttgccggagactcacgctgaaacgtcggatggcgcttatgttcacctgaaaccaaaacactcctgtgcaggtcagtgtaaacattgaccatccggcaatgtgagccaaccggatgaaagctgtccttttagtttagctaagtgcagcggctttggcgcgaattgcgcgaatcatcgcttccagaccttgtgaacgagatggggtgagatgttgggtgagcgccattttttcaaaccacggacgcacatcgaaattgacaatatcctgcggcgtcatctgatcgtagagaataaagacgaccgcaataagccctttcacaatcgccgcatcgctgtcgccctgtaattcaataattccctgggcattctggcgcatgacaatccacacctgactctgacagccctgaatgctattttgtggacttctgtcttcgtcgcgtaattctggcagacgctggcccagctcaataatgtagagatatttctcttcccagttggcgcagcgtaaaaaattacgcagcaacttttctttatccggcaataaagccatagtgcctccctgttatcccagcaaacggtgaatacgttgcaggccggtcaccagacgatccacttcttcatgggtgttatacatggccagcgacgcccgacacatcgcagggacgttgtaataggccatcaatggcattgcgcagtgatgtccggtacgcacagcaatgccgtaattatcgagaaaactgccaacatcataggcgtggtgtttaccgagattaaaagcaataacgccaagcctgttttgtgggccatagagagtgagatccggtacagattccagctgtgatagcgcataatgcatcagattctgttcatactcggctatgttattaagccccagcgccgaaacatactccagcgccgcgccaagaccaatgatgcccccggtattgggtgtaccggcttcaaaccgccatggtgctttggtccaggtagtgccttcactcaggctgacggtggcgatcatagaaccgcccccttcccacggcggcatctcctgcaacaaggcttctttcacataaagaatgccaattccggtggggccatacagtttatgcccggagaacacgtaaaagtcgcaatccagcgcctgaacatccaccggatgatgcatcaccgcctgagcgccatccaccagcacttttgcgccatgctggtgcgcaagcgtgatcatttccgccagtggattttctgtgccaagcacgttggagacatgagtaattgccagcaggcgagttttctcatcaaacagcgtaggcagcgtctccagttgcaacgtaccatcgggattgagcgggatcacacgcagctctgcgccaacgcgtgcgcaaagcatctgccagggaacaatgttagcgtggtgctccatctgactgatgatgatgttatcgcccgcccgcacgttgctgttgccccagctattggcgaccagattgatcccttccgtcgtgccgcggacgaacaccagctcttccgccgaacgggcattaataaacagcgatgcccgcttgcgcacgttctccattttctcggtcgcctgggcgcttaaggtatgaataccacgatgcaccgccgcgtagccatgacgataaaactcggcctcggcgtcaatcacctggctcggtttctgcgcactggcggcgctgtcgagataagccagcggcaaaccgtttacctcacgcgaaagcaccggaaagtcggcccgcactttgtcgacggaaaaaatcatcttgcacctcctggcagccgttgaccgattcgggccagcacctgctgtttaagcccctcatcacgcagtgcttccgtcagttcggcagcgaaggcgtaaatgatcatctgctgggcatcctgctgattgatcccgcgcgagcgcagatagaatatctgttcatcatcaatacgccccaccgtcgcgccgtggctgcatttcacatcatctgcatagatttccagctgcggtttcgtatccacttccgccagtttgcccatcagcagattgttgttggtcatctgaccatccgttttgatggcgtgctgcgcgacgttgatcaaaccgttaaataccgcgcggcctttgtcgctgacgatagttttgtgcaactgtcggctgttacaaaaacctttattgtgttccagccaggtacgggtatcacacacctcgtttttcaccggcatcgccaggctattgatccgcagcgtgctgttttcgccattgagttgcgtactggtgttgtgtcgtaacactgcgccacccagcaggaaactgtggctaaatgcggtggcatcctcagccagcaacaaatcgttatgagcaaagtggtgactgagcgggttttcaaacgccagcttgatatgctgcaagtgggcattcgctgcgacgttgatagtgaaccgtgccccggtaaaatgacgagcatcattcaggctgacaaaatgttcgatcaccgttgcttcggcaccttccgccagatccagatgatgtcggtaatgggcagtgttcacctcttcacctgccacgccctgggtgatatgcattaacagcaatggctttgccggccgttgaccgcgcttcacggcgatatgcgtcacgctttgtgccaggctttccgtcaaatgcagaaacacttccgcctgaatagcgtcgggtaaaccctgacggtcgtcgttaatgctcacttcatatccgctgccttcagttgcatcgctcagtgcgggcacgtaacgcccatcgacaaacaccagccgcacggagtctaacgttaacgctaaggcatcacgctgctgtggggatatctctcccgcaatgctgacaaactggctattgatcagcccttccagcggcgtatatttccagttttcatgtttacgtgtcggcagtccggtacgcagcaattgttgtaaatgctgctgtgcttgcggggagcgttttgtcccttcagcttcaaacaagtgatgccactgttgcagcgcgttactgctgttcggtaagccagccataaccctgctcctccagttgtttgaccaacgtgaaatcgccggatttcacaattcgtccctgatatagcacatgaacgtaatcaggcttgatgtagtcgagaatgcgttggtagtgcgtaacaatgatgaatgagcgcttgccatcacgcagcgagttcacgccatcggcgaccacttttaatgcgtcaatatccagcccggagtccgactcatcaagaatgcataactccggttccagcaccgccatttgcaaaatatcgttgcgctttttctcgccgccggaaaaaccaacgtttaccgaacgggttaataaatcttccggcatcttcaggagagcgattttctcttccatcaaatcctgaaaatcaaagcggtcgagcgtttcctggccgcgatagctgcgcaccgcattaagtgccgtttgcaggaaaaactggttactgacacctggaatctccaccggatactggaaggccataaagatgccttcgcccgcgcgatcttccggcgacagcgcaagcaaatctttgcctttgaactcaaccgtgccgcccgtcacttcataatcttctcgcccggcaagcgttgccgataaggtacttttgcccgaaccgtttggccccataatggcgtgaacttcgccgggatgaacgtcgaggcttaatccgcgcaggatagctttatcttccacgctgacgtgtaaatctttaatacttaacatgtttattccttatccgacgctgtgttcaagactgatggcgaggagtttttgtgcttcaacggcaaattccaacggcagctccgagaacacgtctttgcagaaaccgttaacaatcatcgagatggcgtcttcttcgctgatcccgcgttgcaggcagtaaaacagttgatcttcaccaatacgtgatgtcgttgcctcgtgttccagttgcgcactattgttacgacactcaacatacgggaaggtatgcgccccacaattagcgccaatcagcattgagtcgcactgagtgaaattgcgcgcattggttgccgtcggcatgattttcactaagccgcgataactgttctgactatgtccggcagagatccctttcgagataatggtcgatttggtgtttttaccgatgtggatcatcttggtgccggtatccgcttgctgatgaccgctggtcagcgccactgagtaaaactcaccaatggagttatcgccgcgcaaaatgcagctgggatatttccacgtaatcgctgacccggtttctgattgcgtccatgacattttgctgttttcgccttcgcacaaagcacgcttggtgacgaagttgagaataccgccggtgttgttatcgccaggaaaccagttttgtaccgtggaatatttcacctcggcgtttttatggatgatgacttccaccactgccgcgtgtaactgatagctgtcacgcaccggagcggaacagccttcaatgtagctgacgtagctgtcttcgtcggccaccagaatggtgcgctcaaactgcccggttttttctgcgttaatgcgaaaataggtggaaagttccatcgggcagcgcacgcctttaggcacataaataaacgtaccatcagaggctaccgccgcattaagcgcggcaaagaagttgtcattccccggcaccacggtgccgagatatttacgcaccagttccgggtgatcgtggatcgcctcaccaaaggaacagaaaataattccctgctccgccagtttttcgcgataagtagtggcaaccgaaactgagtcgaaaatggcatccaccgccacctctttgccttcccgcacgggaacgcccaactgctcaaacgccgcctccacctctttacttaaaaaggcgttcgcgccagtttgctgcaccgcgccaggttcagacgcgcaagtgtcgtcacaattaccgcacgatggtgctgagtagtagctgtaatcctgataattcagcttgtcgtagtgcgctttcaaccagtgcggttcttccatctccagccatgcgcgataggcgtttagacgaaactccagcatccactccggctcattacgcttcgccgaaattgcgcgcaccacctcttcgtttatcccctttgccagctcatcggtggctaactgggtgaagaatccttctttataattcagcgggccgccggtccaggttttgacatcgtcagttgcttcagtattacgagacatagtaccgcctataccccaaagctttcgccacagccacattcattctgggctttagggttgtgaaatttgaatatctgattaagtccttcacgaacgaaatcgacttccgtgccatcaataaacggcatcgcttgcagcgggacaaacagcttcgcgccgtcgtgttcaaacagcagatcgtctttgtccggctcgctaacactgtcgagcacatagccaaagcccgcgcagcccgtttgcttcacgcctaagcgcacgccgaccatacccggctgctttgccaccagctcacggatgtgtatcgccgctgcgggtgtcagcgttaagccttgccaggcgaaatcttgtgggttaaaggttcctgaatgcatgtccatcgatttacctcacttcatcgctttcagcgtataacagcatgttagtgataatgattatcagttcaacccagcaaacgcaggggctttaccgtaaaacatgctttttgcctgcttttaataagcatagaccctgatgtgtgggttaacaggcacgctaagaattaggtatctcattgttagataatggttattatctaaggagcattaaggctgtgatgaaaaagaaaaagttgtattgaaaatgactatttaagagataggtaaaaaagtgcagcgttcagaaataagaaaacccttaagtctgtgcgacacaggcttaagggtttctaccccatccggcgcttatctccggcactctcagtggcttagctcttgaaggggcgataagaataatctcataaagctaacccgccgttttaacacaaactgcgattagtattatttttgaacaatatcaggcggtagataagcagtattaagaaggtcatcgaacctggacggaggttaatccaggtcgatttggcgaacttgcggcattaagtcaggatcaatgcacgcccagacgccaggcaaagtagatttcttcttttaattcagcagaagagagagtaagcaggtcagcaaattcaagttctagttgtttcagacgtttgagatattgggcaggtgaaagattgctctggtcacggcgtaaaaattcaatggccagctgggtgggatcaagttgagtagacatagcatcctcgcttttagacaagacctgcacagtataccaccgtttactgtgcagataatgaccaaaagcaatatgcgtcacacttttctggtgacaacgtcacaaaatggcggtcgtcaatcgtgacgaacagcacaaacgccctttctcatcgaagatttcaatctgccagacctggtgacgcgaaccgagatgcaacggtttgcatacgccgcgcacccgcccttctcgtgccgagcggacgtggttagcattgatttccagaccaaccactttttgctcaccttcggtacataaataaccggcaacggaaccgatactttcggccagtaccacggatgctcctccatgcagcaacccgaaaggctgctttgtccgcgagtctactggcattgtcgcttcaagggtgtcatcaccaatatgttcaaagcgaatatccaggaaccccaccatgtttccttcacccatagcattcagtgcttccagggtgattttccgtttccatatcatttaataatctccagtaaagcctgcacaggatggcgtacccccgtgccttcaacccgttttacctggctacggcaggaatatccggtcgccagacagcggttacgcggcagtcgctgcatagcctgatgccaggataactcatagatcccgagcgaattttcatggtttttcgcttcatgtccgtaagtccctgccatgccgcagcaacccacgctgacattttccagtttcgcgccaaaacgggcaaatatcgcggcccattgtgctggcgcacccggcaaggcggtaacttcggtacagtgaccaaagaaataccatgattcaccgctgactgtagccactggctgtgactcaagtgcgcttgccagccattcattcgccagtaagacgttaaactcgccacgctcctcgcccagcgccagtttatattcatcgcgataacaaagtaccagcgccggatcgacgcccaccattggcatacccagcttcgccatacggttgaggaaatccgccgtctttttcgccgtcttcgcaaaacgattaagaaaacctttaatatgctgggctttgccatttggcgaaaatggcagtaacacaggctggaaacctaatttttcgaccagacggacaaaatccgccaccacttgcgcatcgtaatagctggtaaaggggtcctgcaccaccaacactgtgcgcgctttctgctctgcattgagagattcaagctgttccagcgtcatgtttgccgagcgatgccccaccatttgttgttgtagcgaggggaccgacagcagcggcaaatcaaccatgccgatatgtttttccgagagtttgcgcaccagcggctggttaatgaagaagttaaaggttttcggcgcgcgtgccatcagcggcgcgtagctctcgaccgtagcgacgaggtggtcgcgcagcgggcgtaaataacgggtgtgatagagctgcagaaaacgagagcgaaactccggcacatcaattttgatggggcactgggtcgaacacgctttacaggccagacagcccgacatcgcctctttgacttcgtgtgagaagtcatattcgcctttattcgcatgccagctattgcgcgtgcgggcaattaacgtccgcaaactgacgccggattcaggcagttcttgttccagtttgagtggatcaacgccgcgatccgccaacaaacgcagccattcacgcaccagcgttgcgcgccctttcggtgaatgaatccggttctgggtgatcttcatcgacggacacatcggactacgggcatcaaagttgaagcataaaccgttgccgttacactccatcgcaccgcgccactgctggcgtaccgcaatggggatctgccgatcgaatgtaccgcgcttcaccgcgtccactttcatcatcggcgcatcgagaccttctggcgggcaaatcttccctgggttgagtcggttatgcgggtcaaatgccgctttcactttgcgcagttctgcaaaaagttcctcaccgaaaaacgccgggctgtattcagcgcgaaaacctttgccgtgctcgccccacaacaaaccaccgtatttcgcagtcagcgccaccacgtcatcagagatttgcttcatcaaaatctcttgttgaggatcgcacatatccagcgctggacggacgtgcaagacacctgcgtcgacgtgaccgaacataccgtagcttaagccgtggctgtcgagcagcgcgcgaaattcagcaatataatccgccaggtgttccggcggtacgcaggtatcctcagcaaacggaattggcttagcggcacctttggcattgccaagcagaccaacggcttttttgcgcattgcatagatacgttcaacccccgccagctcacggcacacctgccagccgatgacacctgcttgatgactggcgatcagctcatccaaccgcgcacagagtgcatttacccgctcatcaatcagcgcctcatcatcaccagcaaattccacaatgttcagcccgagcatctcttggtcaggcacatcggtaatcaactcgctgacggaatgccagacaatatcttcccgcgccagattcagcacttttgagtccaccgtctctaccgaaagcgcccgcgcctcaaccataaacggcgcgttacgcagcgcagagtcaaaagagtcatatttgacgttcaccagacggcgcactttaggcaagcgtgtaatatccagccgcgcttcggtaataaaggccagcgtcccttctgaacccgtcagaatgcgcgtcaggtcgaactcggtcatctcatcgttaaagacatgacgcagatcgtaaccggtaagaaagcggttaagtttggggaagttgtcgataattaactggcgttgctgacggcaacgttgataaaccgtgttataaattcgcccgattgtggtattggatttacccagcgtttccgccaattcgacgggtaaaggttgcgtatcgagaatatcgccccccaacaacaccgcgcgtacgccaagtacgtgatctgacgttttgccatagaccagcgatccctgaccggatgcatcggtattgatcatcccaccgagcgttgcccggttgctggtcgaaagttccggcgcaaaaaagtagccgaacggtttcaggtactgattgagttgatcttttatcaccccggcctcaacgcgcacccagccctcttcagggttaatttcgatgatgcggttcatatggcgggacatatcaacaataatcccctggttgagcgcctgaccgttagtgccggtgccgccgccgcggggggtaaagatcagcgatgaatagcgttcctgcgcggcaagacgggcgatcagcgccacatctgcggttgaacgcggaaataccaccgcatcggggagaagttggtaaatactgttgtcggtcgacattgtcagacgatcggcataacttgtcgccgtatcgccggtaaaaccttgttgctccagctcttgcaaaaaattaagcaccagttgaacgacgccgggtgcctgggaaatctgtggaatcattatattgaccctttcctgcggtctgtgatgtaggtcgatacactattctttcaggctgctgcaatagcgcactgaaaggtgatgtttgtttactctatggatttcgtgttgcaggaaggcggcaagcgagtgaactccaggagcttacaatagtaagtgactggggtgaacgaacgtagccgcagcacatgcaacttgaaatacgacgagtaaatcgtttgcgtgttgcctgagttgttgtaccacatttttttctaacacgcccatcagaattaagggcagaatcggcctgttaaaaaccgctgaaattgctcatcattatgcaggtgagtttcgcgtgttcacgtcgcgtcgacgatttgacgcacaaaaaaggtgaaaagtagttatggtaaatgttcgtcagcccagggatgtcgcacaaattctgctttcggtgctgtttttagccatcatgattgtggcatgtctgtggattgttcaaccctttattctcggctttgcatgggccggtacggtggttatcgccacctggccggtattgttacgtttgcaaaagatcatgtttggccgccgctctctcgccgttctggtgatgacgctgttattagtgatggtgtttatcatccctattgctttgctggttaacagtatcgtcgacggcagcggcccgctaattaaagccatttccagcggtgacatgacgttacccgatctggcgtggcttaataccattccggtgattggcgcgaagctgtatgcaggctggcacaacttgctggatatgggggggacggcgatcatggcgaaagtccgcccttatattggcaccaccaccacctggttcgttgggcaggcggcgcatatcgggcgctttatggtgcattgtgcgctgatgcttctcttcagtgccctgctgtactggcgcggtgaacaggtggcacaaggcattcgccattttgcaacccgtctggcaggcgttcgcggagatgccgccgtgctgctggcggcacaggctatccgcgcggtggcgctgggtgtggtggtgacggcgttagtacaggcagtgcttggcggtatcggcctcgccgtatccggcgtaccttatgcaacgttgctaacggtgttaatgatcctctcctgccttgtccagcttggcccgttgccggtactgattccggcgattatctggctctactggactggcgataccacctggggaacggtattgttagtgtggagcggtgtggttggcacgctggataacgtcatccgcccaatgttaattcgcatgggtgccgatttaccgctgatcctgattctctctggcgttattggtggtttgattgctttcgggatgatcggtctgtttattggtccggttctgttagccgtttcctggcgtctgtttgccgcgtgggtggaagaagtcccgccgccgacggaccaaccggaagaaattctcgaagaacttggcgaaatcgagaaaccgaataagtaatttctcatcaggcggctctgccgcctgattgttaaccaccgctaattgatatttgcttgctcttccccatattttcctgcttaccgccattcagctggtagtacctgtcgcaaattctttacagtttttaaactaatgagacgaatctgatcgacgcaaaaagtccgtatgcctactattagctcacggttataaatcaacatattgatttataagcatggaaatcccctgagtgaaacaacgaattgctgtgtgtagtctttgcccatctcccacgatgggcttttttttaacatttttccgcttcgctacctcgcccctcactctttccaataatgttgcacaagatactgtgactctcttcaagccgtcagcaggctgataatgttatttatattttattgtttatttcatgcagccattacacgatgaacgcttatgaactccaggcactccgccatatttttgccatgactattgatgaatgcgcgacctggattgcccagaccggtgacagtgaaagctggcgtcagtgggaaaatggcaagtgtgccattcctgatcgtgtagtcgagcaactgttggctatgcgtcagcaaagaaaaaaacatcttcatgccatcatagagaaaataaataaccgcatcggcaacaacaccatgcgttttttccccgacttaaccgcatttcaacgagtctaccctgatggcaattttattgactggaagatctatcaatcggtagctgctgaattatatgcacacgatctggagcggctttgttaatttttccacagaaaggaattgtcgttgttacaacaataatgaacggatgctgacacaacatcgcttcactttttaaagcacctttgctaagtagaacctatgaaaaatccctatttccctaccgcacttgggttgtattttaattacctggtgcatggtatgggcgtccttttgatgagcctgaatatggcctcgctggagacactttggcagactaatgccgcgggtgtctcgatagttatctcatcgctgggcattggtcgattaagtgtcttgctttttgcaggattattatccgatcgctttggtcgccgcccttttatcatgctcgggatgtgctgctatatggccttcttttttggcatcctgcagaccaataacatcattatcgcttatgtttttggctttctggcgggaatggcaaacagttttctcgatgcaggcacttatcccagtttgatggaagcttttccacgctcacctgggacagccaatattttaattaaagcatttgtttccagcggacaatttttattaccgctaatcattagcctgttagtgtgggctgaactgtggttcggttggtcctttatgattgctgcaggcattatgtttattaacgctctgtttttataccgttgtacgttcccaccccatccgggtcgtcgcttacctgtcataaagaaaaccaccagctctacggaacatcgctgttcaattatcgatttagccagttataccttatatggctatatctcaatggcaacgttttatctggttagccagtggctggcacagtacggacaatttgttgcaggcatgtcatacactatgtcgatcaaactactcagtatctacaccgtgggttcgctgctttgtgtatttattaccgctccactcattcgtaataccgttcgcccaacaacattactgatgctgtacacctttatctcatttattgctctgtttaccgtctgcctgcatcccacattttatgtggtgataatatttgcttttgtcattggttttacctctgctggaggtgttgtgcaaattggcctgacgttaatggctgaacgtttcccttacgctaaaggtaaagctacagggatctattacagtgcgggcagtattgcgacctttactattccgttgattacggctcatctgtcccaaagaagtattgccgatattatgtggttcgataccgccatcgctgccatcggttttttactggcactgtttatcggcttacgcagccgcaaaaaaacgcggcatcactcgctaaaggaaaatgtcgctccgggtgggtaatgcaatattcttttcaggtcatgcaagatcttacggataaataactctttctgcgctaactaaggaaaatcgcgatcaaaaacaaactatgacatgcaatattcctggaaacataaactttatgccatgtacccagggaaaatcatcttcagtatagtaattatgtaaaccgtcggagaacaatacgtacggtaacgaaattatctttcagcaaggagctgtgaaaatgtctcaaaataaggctttcagcacgccatttatcctggctgttctttgtatttacttcagctacttcctgcacggcattagtgttattacgcttgcccaaaatatgtcatctctggcggaaaagttttccactgacaacgcgggcattgcctacttaatttccggtatcggtttggggcgattgatcagtattttattcttcggtgtgatctccgataagtttggtcgtcgggcggtgatattaatggcagtaataatgtatctgctattcttctttggtattcccgcttgcccgaatttaactctcgcctacggtctggcagtgtgcgtaggtatcgctaactcagcgctggatacgggtggctaccccgcgctcatggaatgctttccgaaagcctctggttcggcggtcatactggttaaagcgatggtgtcatttgggcaaatgttctacccaatgctggtgagctatatgttgctcaataatatctggtacggctatgggctgattattccgggtattctatttgtactgatcacgctgatgctgttgaaaagcaaattccccagccagttggtggacgccagcgtaactaatgaattaccgcaaatgaacagcaaaccgttagtctggctggaaggtgtttcatcggtactgttcggtgtagccgcattctcgaccttttatgtgattgtggtgtggatgcccaaatatgcgatggcttttgctggtatgtcagaagctgaggcattaaaaaccatctcttattacagtatgggctcgttggtctgtgtctttatttttgccgcactactgaaaaaaatggtccggcccatctgggctaatgtatttaactctgcactggcaacaataacagcagccattatctacctgtacccttctccactggtgtgcaatgccggagcctttgttatcggtttctcagcagctggcggcattttacagctcggcgtttcggtcatgtcagagttttttcccaaaagcaaagccaaagtcaccagtatttatatgatgatgggtggactggctaactttgttattccactgattaccggttatctgtcgaacatcggcctgcaatatatcattgttctcgattttactttcgcgctgctggccctgattaccgcaattattgtttttatccgctattaccgcgttttcattattcctgaaaatgatgtgcggtttggcgagcgtaaattttgcacccggttaaacacaattaagcatagaggttaaaggagttaattatggatgttaccgcaaaatacgaattgattgggttgatggcctatcctatccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctgacaggctgaccgcgtgcagaaagggtaaaaaatgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgacctctccaatgtggagtctgtcatggcggcagcaaaaattctccgtgagaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggtgatgatcaggttaaagaaaccgtcgcctacgcccacgcgcatgatgtgaaagtagtcatgtccaaccatgacttccataaaacgccggaagccgaagaaatcattgcccgtctgcgcaaaatgcaatccttcgacgccgatattcctaagattgcgctgatgccgcaaagtaccagcgatgtgctgacgttgcttgccgcgaccctggagatgcaggagcagtatgccgatcgtccaattatcacgatgtcgatggcaaaaactggcgtaatttctcgtctggctggtgaagtatttggctcggcggcaacttttggtgcggtaaaaaaagcgtctgcgccagggcaaatctcggtaaatgatttgcgcacggtattaactattttacaccaggcataagcaataatatttcggcgggaacaccctccccgccgaactaaaaaatatattcaatcgtatttaataaaaatatttcgtgagtctctgtgcgctaattctccatttggcgtagggaaaatcacatctgaatcaggaattaacaatgaaacctgtaaaaccacctcgtattaatggacgagtgccggtcctgtcggcacaggaagcggtgaattatattcccgacgaagcaacactttgtgtgttaggcgctggcggcggtattctggaagccaccacgttaattactgctcttgctgataaatataaacagactcaaacaccacgtaatttatcgattattagtccaacagggcttggcgatcgcgccgaccgtggtattagtcctctggcgcaagaaggtctggtgaaatgggcattatgtggtcactggggacaatcgccgcgtatttctgaactcgcagaacaaaataaaattattgcttataactacccacaaggtgtacttacacaaaccttacgcgccgccgcagcccaccagcctggtattattagtgatattggcatcgggacatttgtcgatccacgccagcaaggcggcaaactgaatgaagtcactaaagaagacctgattaaactggtcgagtttgataacaaagaatatctctattacaaagcgattgcgccagatattgccttcattcgcgctaccacctgcgacagtgaaggctacgccacttttgaagatgaggtgatgtatctcgacgcattggttattgcccaggcggtgcacaataacggcggtattgtgatgatgcaggtgcagaaaatggttaagaaagccacgctgcatcctaaatctgtccgtattccgggttatctggtggatattgtggtggtcgatccggatcaaacccaactgtatggcggtgcaccggttaaccgctttatttctggtgacttcacccttgatgacagtaccaaacttagcctgcccctaaaccaacgtaaattagttgcgcggcgcgcattattcgaaatgcgtaaaggcgcggtggggaatgtcggcgtcggtattgctgacggcattggcctggtcgcccgagaagaaggttgtgctgatgactttattctgacggtagaaacaggtccgattggcggaattacttcacaggggatcgcctttggcgcgaacgtgaatacccgtgccattctggatatgacgtcccagtttgatttttatcacggtggcggtctggatgtttgttatttgagttttgctgaagtcgaccagcacggtaacgtcggcgtgcataaattcaatggtaaaatcatgggcaccggtggatttattgatatcagtgccacttcgaagaaaatcattttctgcggcacattaactgcgggcagtttaaaaacagaaattaccgacggcaaattaaatatcgtccaggaaggacgggtgaagaaatttattcgggaactaccggaaattactttcagcggaaaaatcgctctcgagcgagggctggatgttcgttatatcactgagcgcgcagtattcacgctgaaagaagacggcctgcatttaatcgaaatcgcccctggcgtcgatttacaaaaagatattctcgacaaaatggatttcaccccagtgatttcgccagaactcaaactgatggacgaaagattatttatcgatgcggcgatgggttttgtcctgcctgaagcggctcattaacaggagtataatgatggatttttctttaactgaagaacaagaactgctgctggccagtattcgcgaactgattacgactaactttccggaagagtatttccgcacctgcgatcaaaacgggacatatccgcgtgagtttatgcgggcgctggcggataacggtatttccatgcttggcgtgccggaagaatttggtggtatccctgcggattacgtcacccaaatgctggcgctgatggaagtgtcaaaatgcggtgctccggcatttttaattaccaacggtcaatgtattcacagtatgcgccgtttcggttctgcagagcagctacgtaaaacggcagagagcaccctggaaacgggtgatcccgcctatgccctggcgttgacggaaccaggtgctggctcagataacaacagtgccactaccacttacacgcgtaaaaacggcaaggtctacatcaacggacaaaaaacctttattaccggtgcgaaagagtacccgtatatgctggtgctggcgcgcgatccgcaaccgaaagatcccaaaaaagccttcaccctgtggtgggtcgactccagtaagcccggcattaagattaacccgctgcataaaatcggctggcatatgctcagcacctgcgaagtctatctcgacaacgtggaggttgaagagagcgacatggtgggcgaagaaggaatgggtttcctcaatgtgatgtacaactttgagatggagcgcctgatcaacgccgcgcgcagcaccggctttgccgaatgcgcctttgaagatgccgcccgctatgccaaccaacgtatcgcttttggtaagcccattggtcataaccagatgatccaggaaaaactggcgctgatggcgattaagatcgacaacatgcgcaacatggtgctgaaagtggcatggcaagccgatcagcatcagtcactgcgcaccagcgcggcgctggcaaaactgtactgtgcacgtaccgcaatggaagtcattgatgatgcgattcaaatcatgggcggtctgggctataccgatgaggcgcgcgtctcccgcttctggcgtgatgtccgttgtgaacgtatcggcggcggtacagacgaaattatgatttacgtagcaggtcggcagatcctgaaagactatcagaacaaataatctgcaggcggcgcagcttcttaacaaactgcgccgccagatttatccaacaagacttaccggttgaggaaattcagataggatttcttgttccgcaaaacagtttttaaattgtctacggtaatcgctgggcgaacaaccgacatggcgcaaaaacagtttggcaaagtgatcgacattttcataacccacacgccaggagatctctgcctgtgataattcagtattagtgagtgaccattttgcttccgtcatacgccgttgaataacatagttaataggggaaatacgatactctttggtaaattcatggcaaatataactgacgctggcacgaaattttttcgataactgttctaaagtgattttttcgcgataattattattcagatagaaaagaatatcttttatcagaacatcttttttaatatacccctgctccgaacgataagcatttttaaaattttcgtagtaaagaatggctaacgtataggcaaatgcatcccataacgaagatgtttggctatttttactttgcggcaaaatcacacttagctcattaaataaggtttttatgacttcttttccctgccccgcggcaattaccggacaagaatgcggttgcagtagctgattttcctcagccccctgaaactgaaagccgtacagcgcacaggtacacgtcgttgccggatcgttaacgtcagaggccaccgcatgcagcctgccgcgttctatcaccacaatgtcatccgcatgtgcgacatataacgaagaatcgatggtaaaccttgcaacccctttcttgacgtaaatcaactcggtttcattgtcatgaacgtgatgtccggactcccattttggatcatcgctaaatgcaaaacgtgaaagccgtggcgttttaccggcgacaaacagcgtttcactggcgttatcaaaacagcgttgatacatgacaacctccctattccatgagcaagcaaaaacaatatatgccggataaaatacggcgtgtattgcggttatacaaccgcgtttagcgagagctaaacaagattatttacactgaatgcaagattgtacggtcatggaataactatattgccgcaaattgcacttttgttttagcgatcgcattttttttgcaagattgttggcaaggaaaacagcttgctccgtcgaaaaccccgcaccgctatcgcacactattttcaggccatttttaccttccatcggagatggttccgtatgcgactcacaggagaaatcatgaaaataataacctgctttaagctggtgcctgaagaacaggacattgttgtcactccagaatacaccctgaatttcgacaatgccgacgccaaaatcagccagttcgatctcaatgccattgaagctgcaagccagctcgcaacagatgacgatgagatagccgcgctgaccgttggcggctcattgttgcagaactcgaaagtgcgcaaagacgtgctatcccgcgggccgcacagcctgtatttggtgcaggatgcgcaacttgaacatgcactgcctctcgataccgcaaaagcgctggcggcagcaattgaaaagatcggcttcgatttactgatctttggtgaaggttccggcgacctttatgcccagcaggttggcttgctggtcggagaaattctgcaacttccggtgattaatgcagtgagtgctattcagcgtcagggcaatacactggtgattgaacgcacgcttgaagatgatgttgaagttattgaactctctgttccagccgtgctctgcgtcacctccgatattaacgtgccacgcattccttcgatgaaagccattctcggcgcgggtaaaaaaccggtaaatcagtggcaggcaagtgatattgactggagccagagcgcgccacttgctgaactggtcggcattcgcgtaccgccgcaaacagaacgtaagcacatcattatcgataacgattcgccggaggccattgccgagctggcggaacatctgaagaaagccctgaactgaagcctacggagaagaaacgatgagtcaattaaacagcgtctgggtctttagcgataatcctgaacgttatgctgaactgtttggcggcgctcagcaatggggccaacaggtgtatgccattgtacaaaataccgaccaggcgcaggcagttatgccttatggtccaaaatgtctttatgttcttgcgcaaaacgacgcgctgcaacgcactgaaaattacgccgaaagcattgctgccctgctgaaagataaacaccccgctatgttgctgttggccgcgacgaaacgtggtaaagcgctggcagcacggttaagtgtgcaactgaatgcggcgctggtgaacgatgccacggcggtggatattgtcgatggtcacatttgcgccgaacaccggatgtatggcgggttagcgttcgctcaggaaaagatcaacagcccgctggcgatcattacccttgcacccggtgttcaggaaccgtgcaccagtgatacctctcatcagtgcccgacagaaacggtaccttatgttgctccgcgtcatgaaattctctgtcgcgaacgccgtgcgaaagccgcaagcagcgtggacctgagcaaagcaaaacgtgtggttggcgtcggtcgtggactggcggcgcaggatgacctaaaaatggtccacgaactggcggcggtgctgaatgctgaagtcggctgttcacgtccaattgccgaaggcgagaactggatggagcgtgaacgttatatcggtgtctccggcgtgttgctgaaatccgatctctacctgacgctggggatctccgggcagatccagcatatggttggcggcaacggcgcaaaagtgattgtcgccatcaataaagataaaaatgcgccaatcttcaactatgccgactacggtctggtgggcgatatctacaaagtcgtccctgccctgattagccagttgagccgctaattcccctttcaaccacatctcccgctgtaaacgcagcgggaagggagcataacgcatgtcggatgacaaatttgatgccattgtggtcggtgcgggcgttgctggtagcgttgccgcactggtcatggcacgagccgggctggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgagcagccagatgttccgcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatgggcgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccagcagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccatcgacggcaaaccaaaccagccggtacgaaaaatgatcatgggacatgcgaagaaaattgggctgatcaacttgctgaaagatggcattaagggagcaaccgcgctatgagccagaacgctacggttaacgtcgacatcaaattaggcgtcaataaattccatgttgatgagggccacccgcatatcattctggcggaaaatcccgatatcaatgaattccataaattaatgaaagcctgccctgccggactttataagcaggatgacgcaggaaacattcattttgattccgccggttgtctggagtgcggcacctgtcgggtgctgtgcggtaacactattctcgaacagtggcaatatcccgcaggcaccttcggtattgattttcgctacggctaatcatgcatcccacaggcccgcatctcgggcctgatgttctgtttcgagagtccaacatgaaagtgacattaacgtttaacgaacaacgtcgtgcggcgtatcgtcagcaagggttatggggcgatgcttcgctggccgattactggcagcagaccgctcgtgcgatgccagacaaaattgccgtggtcgataatcatggtgcatcgtacacctatagcgcgctcgatcacgccgcgagctgtctggcaaactggatgttagcgaagggtattgaatcaggcgatcgcatcgcatttcaactgcctggctggtgtgaatttaccgttatctatcttgcctgcctgaaaatcggtgcagtttccgtgccgctgttgccttcctggcgggaagcagaactggtgtgggtgctcaataagtgtcaggcaaaaatgttctttgcaccgacgttgtttaaacaaacgcgtccggtagatttaatcctgccgctgcaaaatcagcttccacaactacaacaaattgtcggcgtggacaaactggctcccgccacctcttccctctcattaagtcagattatcgccgacaatacctcactgaccacggcgataacgacccacggcgatgaattagctgcggtgctgtttacctccggaaccgagggtctgccaaagggcgtgatgctaacgcataacaatattctcgccagtgagcgggcttattgcgcgcgactgaatctgacctggcaggatgtctttatgatgcctgcgccacttggtcacgcaacgggctttctgcatggcgtaacggcaccattcttaattggcgctcgcagcgtgttgttagatattttcactcctgatgcgtgtctcgcgctgcttgagcagcagcgttgcacctgtatgctcggcgcaacgccgtttgtctatgatcttttgaatgtactagagaaacaacccgcggacctttcagcgctgcgtttctttctttgcggcggaaccacaatccccaaaaaagtggcgcgtgaatgccagcagcgcggcattaaattattaagtgtttatggttccacagaaagttcgccgcatgcggtggtgaatctcgatgatcctttgtcgcgctttatgcacaccgatggttacgctgccgcaggtgtagagattaaagtggtcgatgacgcacgcaagaccttaccgccaggttgcgaaggtgaagaagcctcgcgtggccccaatgtgtttatggggtattttgatgaacctgaattaaccgcccgtgccctggatgaagaaggctggtattacagcggcgatctctgccgtatggatgaggctggctatataaaaattaccggacgcaaaaaagatattattgtccgcggcggcgaaaatattagcagccgtgaagtggaagatattttattgcagcatcctaaaattcacgatgcctgtgtggttgcaatgtccgatgaacgtttaggtgaacgatcatgcgcttatgtcgtgctgaaagcgccgcatcattcattatcgctggaagaggtagtggctttttttagccgtaaacgggtcgcaaaatataaatatcctgaacatatcgtggtaatcgaaaaactaccgcgaactacctcaggtaaaatacaaaagtttttgttaagaaaagatattatgcggcgtttaacgcaggatgtctgtgaagagattgaataagtttcatcttcggggatcacataaccccggcgactaaacgccgccggggatttattttatttcttcagttcagccaggcttaaccaggtttgcaccacggtgtccgggttcagagacaggctatcgatcccctcttccatcaaccatgcggcaaagtcttcgtggtcggacggaccctgaccgcaaatcccgacatatttgccctgtttcttcgcggcacggatagccatcgacagcagtgctttcaccgcatcgttgcgctcatcgaacaattcagacaccacgccggagtcacggtccagaccgagcgccagctgcgtcatatcgtttgagccaattgagaagccgtcgaaatattcgaggaactgctcggccagcaaggcgttggacgggatttcacacatcatgatgattttcagcccgttctcgccacgtttcagcccctgacgcgccagttcttcaaccaccgctttcgcctgatctacggtacgcacgaacgggatcatgatctcaacgttggtcagtcccatgtcgttgcgcacacgtttcactgcttcacactccagcgcgaaacagtcgcggaagctgtcggaaacatagcggcccgcgccacggaagccgagcatcgggttctcttcatctggctcgtaacgctcaccaccgaccaggttggcatattcgttcgatttaaaatcagagagacggacaatgacgcgcttcggataaaacgcggcacccagcgtcgcgatcccttcagtcagacgaccaacgtaaaattcacgcggagaatcaaaacctttcatcatctcgcggatttcgttttgcaactgcggttcctgatcgtcaaactcaagcagtgcgcgtgggtggacgccaatcatacggttgatgataaattccagacgcgcaaggcccacgccttcgttcggtaggcaggcgaagtcgaaagcacggtccgggttaccgacgttcatcatcactttcaacggcagatccggcatcgtttctacgctggagcttttcacgctaaattccagcaactccgcatagacgtaaccggtatcaccttcggcacaagaaacagtgacgttctcaccgtctttcatccgttctgttgcatctccacagcccactaccgccggaatgcccagttcacgagcgatgatcgccgcgtgacaggtacgaccgccacggttggtgacgatggcagatgctttcttcatgatcggttcccagtccgggtcggtcatgtcagtaaccagcacgtcgccaggttcgatgcggttcatttcgctgatgtcatggatgactttcaccggacccgcaccgatgcgatgaccgatagcacggccttcggcgataatcttaccctgtgaatgcagcgtataacgctccatgacctgaccgcgtgagcgcacggtttccggacgcgcctgcacaatgaacagtttaccggtgtggccatctttcgcccactcaatatccatcgggcgaccgtagtgtttctcaatttgtacggcctgttttgccagttcctgcacttcttcgttggtcagcgagaagatgtcacgctgttcctgcggtacgtcttcgattttaacctgcttgccgtgctcctgggtcggcgcgtaaaccatgcggatttttttcgaccccatggtgcggcgcacgatagccgggcgattcgccgccagtgtcggtttatgcacgtaaaactcatccgggttaaccgcaccctgcacgaccatctcaccaaggccccatgcggaagtgataaacaccacctggtcaaagccggattcggtatcaatggagaacatcacgccagatgatgcgaggtcagagcgcaccatccgttgaacaccggcggagagcgccacaccacggtgatcgtaaccctggtgcacacgataagagatggcgcgatcgttaaacagagaagcaaatacatgtttcactgccacgagaacggcgtcaaaaccctgaacgttgaggaaggtttcctgctgaccggcaaaagaagcgtccggcatatcttctgcggtggcggaggagcgcaccgcaaaagaggcgttttcgtcatcggcggaaagctgtgcataggcttcgcggatggcgttttccagctcaggctggaagggagtgtcgataatccactggcggatttgcgcgcccgctttcgcaagctgagtaacatcgtcaatatccgttttatccagcagttcataaatgcgctggtttacgccgctttggtccagaaactggttaaacgcgtcggcggttgtggcgaaaccattcggaacggaaacacccattccggaaagattagtaatcatttcacccagggaggcatttttgcccccaaccctgtctacatcattcatgccgagttggttataccaaagcaccagcggtgacgagccattgttggacatcgaacaatccttttgtgataaatgaacggtttgagaaacacatttctgcgcatttatctttgcatatttaaccggatgaaaaaaacggtgaatcgttcaagcaaatatatttttttactttttaagactgatcccagcgttgcgcaaatctgctctcttcgacaatttccacataaaccatcggtataaacgaaaccataaaaatgaaatgctgttttcataaaaaataaaattgaaggttcattttataaaccagacataacgttctacgcttctgtgcgtttttaatttatgctttcatagaattatgtctgcatcacgggaagaacaaaatggataatgctgttgatcgccacgttttttatatttctgatggtacggcaataactgcggaggtattaggacacgcagtaatgtcacaatttcccgtcactatcagcagcatcacgctgccgtttgtcgaaaatgagagccgtgcacgggcagtgaaggatcagattgacgcaatttatcaccagacaggcgtgcgcccgctggtcttctactccatcgtgttgccggagattcgcgccatcatcttgcaaagtgaaggcttttgccaggatatcgttcaggcgctggttgccccgctacaacaagagatgaaactggatccaacgccgattgctcatcgtacccatggccttaaccctaataatctcaataaatatgatgcgcgcattgcggcgattgattacaccctcgcccacgatgacggcatttcgttgcgcaatctggaccaggctcaggtgatcctgctcggtgtttctcgctgtggtaaaacccccaccagtctgtatctggcaatgcagtttggtatccgcgcggcaaactacccctttattgccgacgatatggataatctggtgctacccgcgtcgctcaaaccgcttcagcataaattgttcggcctgactatcgacccggaacgtctggcggcgattcgcgaggaacgtcgggagaacagtcgctatgcctcgcttcgtcagtgcaggatggaagtcgcggaagtggaagccttgtaccgtaaaaatcagatcccgtggattaacagtaccaattattcggtagaagagattgccaccaagatcctcgatatcatgggccttagtcgccgaatgtactagagaactagtgcattagcttatttttttgttatcatgctaaccacccggcgaggtgtgacacacctcgcacttgaaatcagcagcgattggtttatcgtgatgcgcatcacttcccggcagtcctgccgtagaagcaacaaatttctgagacttgtaatgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctgaatgcgtgcccattcctgacggaatgggcatttctgcgcaacttgttgtcttctcaacaaattactgcttgctctggtcagccataatattgataataagaatcattgttatatcaattattattaatttttatgcgttatacggatagcagaaaactcacgcctgaaacggatgccaatcacaagaccgcttccccgcagcctattcggcgaatttccagccagacactgttaggtccggatggcaaactgattatcgatcatgacgggcaagaatatctgctccgtaaaactcaggctggcaagctgctgttgaccaagtagcctttaactcgagcagctgacttccagccgtttaccccagtcaggtggacgactgacatagtcatcatctctgtcgctgaaaggatttcgcaacgcctcatgcaggcggtgcaattccgtcatatcacccttttctgccgcttcaatcgcccgttgcgccaaccagttgcgcaataccagagcggggttaacgctttgcatcagttgctgacgctcactatcgctaacctcgtcttgttgcaaacgcccccgataacgggcaaaccagtcatcaaatgccgcacgatcaataaactcatcacgtagcggtgacgccgcgctgtgctgctcggtcagactcagcatgcggaatgtgcgggtataatcgctgcgctctcgcgccatcagactgaataattcattcagtagcgcgttatcctctttttgctccgtcatgaagcccagtttctgccgcatccgttctccataatgcgtcaacaaaacctgctgatagctgtccagggcctcattcagggcatctacggcaacaaatggcgacaatgtctgcgccagacgctgtaaattccacaacgcgacggcaggttgattatcaaagctgtaacgcccttgatgatccgagtgattacaaataaaaccgggttcgtaatcatcaagaaaaccaaacggcccgtaatcaagcgtcagccccagcagcgacatgttgtcggtattcatcaccccatgagcaaagccgaccgtctgccattgggcaattaacgacgcggtacgtgcgacaacatcgctaaaccagagacggtatttgtcctcatcatctgcaagatgtgaccagtaatgacgaatagcaaagtcagctaactgacgaaccttttccgactcgcggcggtagtaaaaatgttcgaaatgaccaaagcgcagatgacttggtgccacacgcatcagcatcgcgcctggctccgccgtttcccgatacactggcgaatcgctggtgacgatacttaacgcgcgggtcgtcggaatgcccagataatgcatcgcctcactggcgagactttctcgtatcgtcgaacgtaaaaccgcccgtccatcacccattcgcgaataaggcgtcaggccagcacctttcagatgccagtccattgtagtgccatcagcaagcagttgttcgccgagtaaaatgccgcgcccatcacccagttggcccgcccagacgccgaactgatgaccactgtaaacctgcgccagtggtgacataccaggcagtagggcttcgccgccccagacacctgcgccatttttaaacagcgacgatggaatactcagcgtgttagccagttcggtattatgccaaatcagccgggcattatttaaaggcgtaggggaaagtgctgtataggtttctggcaattcatcgcgccagcgggtaacaaaagacagggtcatagatcctcctgtttgatagtgtagacggttactctcgtcttaaacaccagcaaacagaagggttatcgctgaaccaacgtcgttatctgatttatgggaacggcaggccacaggcatccctggagagcatggaaatcgaagggggtaatctgtgccaatatttctgccgtatcaatgcctcccgcaatgatgcaattgcaacaaggggaaatttgcgcctggatcgcacgaataaacggttcgaaggagcggtgcgtgatttgttgctgaataaaacttttatccagcatgacgcgggtgaaaagaccatcaaaaaccgctttcattgtgctattgcctgctcccaaattacctaacacaaggggatacacttgcgataaggataaaagaccgcgattatcttttccttcattgagatgcgggtaattctcattaatcaacagttcaataaacggatattttaatagttcgcctgcgtaattatccctctctaataataatgtagccacttgtggcgttaaattaagccaggcaaagagtttatgttgaataaaaaaatgttggcatgattttagtaattccaactgctctgaaaataattgccaatgttgctcctcggtaagttgcgctataacccgactcgtcgggatacgaaccgtaccatcttcactggagaaatgggtaattaactcaacgccgacaaggacttgctggttgtctcttatcggcaggaaatagcaatcagaatgataaagattctccaaaaaaatcttcatggtaaccgtccctctcgaaggatgtttttcagtatccggctaaaagggatgaggccataagacataacaattacagaaggagtaactttcatttgttccatgttaaccactttttcaggggtcctttttttagattatcctgattataaacgaataatccatttacggaatttttgtctgcaaaatactactgtattcaggagtaaatggacggcgatgtatcatcgccgtccatttttcgacatactagattcgtctcgcctgccagaaatttttctgccaatagacattatcaagtgaggaacgcatcactcccttgctggtagaggcgtggataaattggttgttggtatcgtaaatacctacatgcaaaccattttgtccggaccccgttttgaaaaagaccaggtcacctggcagcaactcgtctttatcaatttgcgtgccaatagaggcttgttgtttggtttcacggggcagctgcaaatcgaaacgatcgcgcatcgtcacaaccacaaatcccgaacagtccacaccgcgccgcgtcatgccaccataacgatacggcgtgccatgccagctttgtagctggtcgttcaaaccggcaataacggtaatcgaatcagaaagtctggcatttggcggcggtgctttatggtggctacacccggccagaagcagtgctgtgatcaaaataaggcagaaacgcattccgtacggttcctctgttttttattcttgcattaatttagcgtcgtaattacccgattttcaagatactaatgaaatcagatggtcgaaatcagcattctgtgaccttcgatatccagacggcgaaaattcatcccataggcctgcgccagatttggcggcgtgagcacctcttccctgcgtccactggccagcatttttccaccttttagcaaccacgcccgatgcgcatgacgcaatgtgtggttgagatcgtgactgctcatcacaatcgccagtccttgctgacacagcgcgctcagaattttgtctaacgcactttgttgcgcaacatcaagactgttcatcggctcatcaagaagcagcaattggcctgcgggattggcttgtggtgtgatttgcaacaccaccgcagcaagacgtacgcgttgccattcaccgccggaaagttgattggtgctacgtccgagtttgtcatcaagagccagcgcccctgcgacatcattcagtagttcggtacgcgttttatcgtgctgatgcagtgtcaggtagtgccagaccggcgttgcaaacggcggcgtctgctgttgtgaaagataggcgcgatgcagcgcgagttttgttgcggaccatgcttccagtggttgccccgcgaactgaatgcttcccttaccgctggtcattccggccattcgcgccagtaaggtactcttacccgcgccattcggccccaccaggtgcaggatctccccagcccgaacctcgccagaaagcggccccaggcgggtagattccgcaacatcttgtaactgcatcacaatagacattattttgccaacgccagtttaatgctttccatcacaatgggatcttccggcgtcatatccggggaaaaacgctggatgacttttccgtccctgccaaccaggaatttttcaaaattccataaaatatcatccgggtacagcggtgcacggcctttgctgaccatacgggcatagaatccgctctcttccggcgcgactgcggtcggcgctgcggcaatcaatttttgatacagcggatggcgtccttcgccattaacttcaatcttactgaacatcgggaacgtcaccccccatgtggtggtacagtaagttttaatctcttcatcgctgcccggttcttgttccagaaactggttgcacgggaatcccagcaccataaaacctcgatcgacccaggctttctgaatattctccaactgctcatattgcggcgttaagccacactttgaggcgacattgacaatcaacagcacattaccggcgaacttctccagcgtggtcacttcaccgtcgatatctttcactacggtcgtcagaatggaatcttgcatcgtttctcctgggtgtggtcagtaaaaatcttagcttttaatcatagaccgtctttttgcggctaacgtcctgcttttaacaataaccagataaacaccggcgcacctaacgttgcggtgaccacgccaataggcagctctgcggcagctaatgccaggcgcgctacaatatcggccagcagcaatgcgctcgcccctgccagcgcgcagccgggaagtaatacgcgatgatcggttaaaccacacaaccggagaatatgggggatcaccagaccaataaagccgatagcacccgccagcgccacactgacgccaaccatccagccggtcgctgccaccagcacattgcgccagaaccacaggggtaaacccagttgccgcgccgagatctcgccaagtgctaacatattcatcggcctggactgacaacagatccacaacaacacggggatcaatgccagcatcagccagctttgccgccagtctacgccgccaaaaccgcccatcatccagtacatcagctgacgcaaatcaactgaggtggaaaagtagatagcccacgtcattagtgcgctacagataatccctaatgcaacgccagccagcaataaccgactggtcgaaagatgacgacgggcgaaacgtaagagtattaaagtgatgataagcgcgccagcaatcgcacacagccctagcgcccagttggggagttgcccttgcccaagcaataccgcggcgataagccccacgcctgcgccgttagagacgccaagtagtccaggttctgccagaggattttcaaacaacgcctgcattacagcgccggatatagccagcgccgcaccaaccagcaatacagccagcgtacgtggcaggcgaatttgccagacgaacagttcgccacgaggagtaaaccagtcacctggcgagatccattgttcaccggcgcaaaggcttaagagaagcgccagcagcatcaaaactgacaggcataataaccagcgaatattttgtcgctgttgttggcgggcaagtgtcagcatggtatccgttctgctgaagtgtcatggcgttgattttacggtgactcttcgacagtgaaaagaaaaaaggccgcagagcggcctttttagttagatcagattactcgtctttgggcgaagcgttttcgacccggctttttaacttctgcccgggtctgaaggtcaccacgcgccgtgctgtaatgggaatatcctcgcccgttttcgggttacgtcccgggcgttgattcttatcacgcagatcgaagttaccaaaaccagagagtttcacctgttcgccgttttccagagcgcgacggatctcttcgaaaaacagttcaaccagttctttggcatcccgcttgctaagcccaagcttatcaaacagatattctgacatttcagcttttgtaagcgccataggttcaatccctcaatgatgcctggaatcgctcttttaatgcctctacacatttggcgacggtagcggcaatctcctcttcttcgagtgtacggctggtatcttgcaggatcaggcttatggcgaggctcttatacccctccgcaacacccttaccgcggtacacgtcaaataagtttacgccaactacctgatttacgccaactttcttacattcggataaaatatccgctgcgggaacgttttctgcgaccaccaccgcgatgtcacgacggttcgccgggaagcgagaaatctcgcgcgcctgaggcaccacgcggtctgcgagcttgttccactccagttcgaacaccagagtgcgaccgttaagatccagtttacgttccagttcaggatgaacaaccccaacaaaaccaatacgttcacctttcagataaatcgctgcggattgccccggatgcagtgccggattcgcttctgcacggaactcaacctcattcagtttaccggtcaggtcgagaacggattcaagatcgcctttcaaatcatagaaatcaacggtctcttttgccaggttccagtgctcttcgtaacggttaccgcaaatcacaccggctaacatcagatcctgacgaatgcccaacggtgcctgagtatctggtacgaaacgcagaccgctttcgaaaatgcgcacacggttctgctgacggttctggttgtacaccacggttgccagcaggccagtccacagagaaagacgcattgctgacatttcaacagagatcgggcttggcagcagtaaggcttcaacgcctggatggatcatctgctgcactttcggatcaacgaagctgtaggtgatcacttcctgatagcctttgtcgttgagcagcgttttcacgcgcttgagcgacaggtcagcttcacggtgagtacccataatcaggcttgcctgtaccggctcatccgggatgttgttgtagccgtaaacacgcgcgacttcttcaaccagatcttcttcaatctccatatcgaaacgccagctcggcgcaactgcctgccattcgtctttgccttcggtcacttcgcagccgagacgacgcagaatgtcagttacctgctcatccgcaatatgatggccgatcaggcgatccagtttgctacgacgtagagtgatggttgcacgcttcggcagcgttgcttcgttggtgatatcaattaccgggccagcctcaccaccgcagatgtcgatcagcagacgggtcgcacgttccatcgctttgtgctgcagtgccggatcaacgccacgctcataacggtgagacgcatcggtatgcaggccatgacgacgagcacgaccggtgatagacagcgggctaaagaacgcgcattccagcagcacgttttgtgtttcgtcattcacgccagagtgttcgccaccgaagatgccgcccatcgccagcgccttgttgtggtcggcgatgaccagagtgtcagcattcagcttcgcttcagtaccgtcgagcagcaccagcgtttcgccctctttcgccatccgcaccacaatgccgccttcaatgcgatctttatcgaaagcgtgcatcggctggcccagttcgagcagcacatagttggtgacgtcaacaactgcatcgatagaacggatcccgcaacgacgcagtttttctttcatccacagcggagttggcgctttaacgttaatgccttttaccacacggccaagataacgcgggcaggcttccggcgcttcgactgtaatcggcagcgtgtcgtcgatggtcgcaccaaccggaacgatttccggttgaaccagcggcagctggttcagcacggcaacgtcacgcgcaacaccaatgatgcctaagcagtcggcacggtttggcgtcacgctgatttcgatggtgttgtcatcaagtttcaggtattcacggatatcggtgccaatcggcgcatccgcaggcagttcgataatgccgctgtgatcgtcagaaatgcccagttcagagaaggagcacagcatcccttcagacggttcgccacgcagtttcgccgctttaattttgaaatcacccggcagaacagcaccaatggtcgctaccgctacacgcaggccctgacggcagtttggcgcaccgcagacgatgtccagcaggcgatcgccgccgacattcacttttgtcacacgcagtttgtcagcgttcggatgctgcgcacactcaaccacttcaccaacgaccacgccgtggaagctgccggcaaccggttctacaccgtcaacttccaggcccgccatagtgatttgatttgccagcgcatcgctatcaatcgccgggttcacccattcgcgtaaccacagttcactgaatttcataatctattcctgccttatttaaactgtttgaggaaacgcagatcgttttcgaagaatgaacgcaggtcggtgacgccgtaacgcaacatagtcagacgctccatccccatcccgaaggcgaaaccagagtaaacttccgggtcgatgccaacgttacgcaacacgttcggatgcaccatcccgcagcccagcacttccagccatttaccgtttttacccatgacgtccacttctgcagaaggttcggtaaacgggaagtaggaaggacggaagcgaatctgcaaatcttcctcaaagaagttacgcaggaagtcgtgcagcgtgcctttcaggttggtaaagctgatgttggtatcaacaatcagaccttccatctgatggaacatcggcgtgtgagtctggtcgtagtcgttacgataaacacggccaggcgcgatgatacgaatcggtggctgctgggctttcatggtgcggatctgtacgccagaggtctgggtacgcagcaggcgggtagtgtcaaaccagaaagtgtcgtggtcagcgcgcgccgggtggtgaccaggaatgttcagagcatcgaagttatgataatcgtcttcgatttccggcccggttgccacggtaaagccaagctcaccgaagaaactttcgatacggtcgatggtacgggtaaccggatgcagaccgccgttttcaatgcgacgacctggcagagagacatcaatcgtttccgccgccagacgcgcattcagtgcagcgctttccagttccgctttacgcgcattcagcgcctgctgaacctgctctttcgcttcgttgataaccgcaccagctgccggacgctcttctggcggcagctcacgcagggtcgtcatctgaagggttaagtgcccttttttacccaaatattcgacgcgcacattatctaacgcggcaacatctgacgcctggctaatggccgccttcgcactggcaaccagttctgcgagatgtgacatggttttcctcattgtgtcagtggtgacactggttcgttggacttagagcctatcccatcaggctattttacttgccattttggtcccgggctgtgctcgaaattctcacgtacttaaatacgctccggtttctccgcgctggccgtgtccagtctggctgcgacaattacacctgatgagacaggctttttatttttcaaaacgcgcatacaaaaaaagcctccactgggaggctttcaggcgctgttttccgtttctcttctcacgcgctagcctcctggattcaggtgctaaagtaaaaaaagaagcggaaaatagcagcattcattgcttgcgttaccttttggtactcttcaaaagacctttattgaaaaggctacggcgataaaagtcaatgttttgatggcgttgaaacgaaaagagggagactagctccctctttcaactggcttatgccagagctgctttcgctttttcaaccagagcggtgaacgctactttgtcgaatactgcgatatcagccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcacggtaagcatactgaccagctttgataacagcctggaaggcaacgcggtatacgcgagaacgcgcaccgtagtagcctttagcttgtttcaaaattttcttgtgacgtgcacgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaaagcctgtgaagcccgaaggctccacagacagtgctacttgaaggccttactgtttcttcttaggagcgagcaccatgatcatctggcggccttcgatcttcgttgggaaggattcgaccactgccagttcttgcaaatcgtctttcacgcgattaagcacttccataccgatttgctggtgcgccatctcacgaccgcggaaacgcagcgtgattttggctttatcaccctcttcgagaaagcgaatcaggctgcggagttttacctgatagtcgccttcatctgtaccaggacggaatttaatttccttaacctggataactttttgctttttcttctgttccttagaagacttgctcttttcatagaggaatttgccgtaatccattatacgacaaaccggcggctcggcgttagggctgatctcgactaagtctactccggcttcttctgctttctccagagcttctctcagactcacaataccaagctgctcgccttccagacctgttaagcgaacttcctgggcgcgaatttcgccattgatacggttagggcgcgccgtttgaactcgttttccgcctttaataccttattcctccaattgtttaagactgcggctgcgaatctcttgttgcagcttctcgatcacttcatttacgtccatgcttcccaggtctttaccacggcgggtgcgaacggcaactttgcctgattccacctctttatcaccacagaccagcatatatgggacgcgacgcaaagtgtgctcgcggattttaaagccaatcttctcatttctcaagtctgctttaacacgaatgcccgcatttgatagtttttgcgtcaattcgttaacgtattcagactgtgaatcggtaatattcatgataacaacctgaaccggcgcaagccaggtcgggaagaaaccagcgaactcttcggtcaggataccgatgaaacgttccatcgaccccagaattgcgcggtgaatcattaccggtactttacgttcattgtcttcgcctacataagaagcgctcagacgagacggcaaagagaagtccagctgtactgtaccgcactgccatgcacgatcgaggcagtcatacagggtaaattcaattttcggaccgtagaaagcgccttcacccagttgatattcaaacgggatgttgttttcttccagcgcaaccgccaggtccgcctcagcacgatcccacatttcgtcgctgccaatacgtttttcaggacgagtggagagtttgacgacgatcttctcgaagccaaaagtgctgtacatatcatagactaaacggatacatccgttaacttcatcgcgaatttgttcttcagtacagaagatatgcgcgtcatcctgggtaaatccacgcacgcgcatcaggccatgcagcgaacctgacggctcgttacggtggcagctaccaaactcggccatacgcagcggcagatcgcgataagacttcagcccctggttgaaaatttgtacgtgacccgggcagttcatcggcttaatgcagtattcacggttctcagaagatgtggtgaacattgcatctttgtagttgtcccagtgaccggttttttcccacaggacacggtccatcatgaacggacctttaacttcctgatactggtactctttcagtttagaacgaacaaacacttccagttcacggaagatggtccagccgtcgttgtgccagaataccatacccggcgcttcttcctgcatatggtacaggtcgagctgtttaccgattttacggtggtcgcgtttcgcggcttcttccaggcgctgcaggtaagcgttaagtgcttttttgtctgcccacgccgtaccgtaaatacgttgcaacattttgttgttgctgtcgccacgccagtaagcccctgccgttttcattagtttgaaatgatggcagaaacgcatgttcggtacgtgcggaccgcggcacatatcgacatattcttcatggaagtacagacctggcttgtcatcatgggcgatgttttcgtcaagaatggagactttgtagctctccccacggttggcgaaagtttcacgcgcttcgtgccagctgactttcttcttaatgacgtcgtagtttttctcagcaagctcatgcatccgcttctcgagtgcttcgacatcttcctgggttaacgtgcggtcaagatcaacgtcgtaataaaaaccgttgtcaataaccgggccgattgccattttggtatgcggccaaagttgtttaatcgcgtgccctaacaggtgcgcacaggagtgacgaatgatctccagaccttcttcgtctttggcggtaatgatcgacagttgtgcgtcgttttcaatcagatcgcaagcatcaaccagttcgccattaacgcgccctgcgatacaggctttcgccagacctggaccaatgtccagcgcaacatccatggggcttacagcgtgatcgtaatggcgttggctgccatcaggaagagttataacaggcattttatatccttatttgcagtggtgacccacacgaaagatcacatacaaagaaaaatttgtttattaacagttcattgcgaaaccatctagccaacaaatgctaaattggttcgcaatcaggtacacaaatgaaagacattaacctctcaccttccacccggttgagcgatgttaacactaaaaaaagggagattgtacctttccgtttcacattgattcgattcgcaattcgtttgtagtgagtacaccagcaaaacgcttaaagaacaactgataacatcacggtgcgtctgaaaggtttactgcgagcggatttacagcagcataaactgaatccagcaaagttcgttgcgtgatttggcggtagtattttaaacgctcatgagattaatgacgaagtggtcatatcacaatgataaaagtgacacaattcttataacaatttttcgtgcacatttcgttctggcgataataattaatcatcatcctcaaaacctccagatatatataaggcgaacagattatgagtcaaaacgatatcattatcagaactcattataagtctcctcatagattgcacatcgatagcgacataccaacaccttcatcagagcctattaatcaatttgcgcgccagctcatcaccctacttgatacctctgacttaagttcgatgctgtcatactgtgttactcaggaatttaccgcaaactgtcgaaaaatatcacaaaattgttattccactgccctttttaccattaactttgccacttcacccatccatacagaaaatatactcattacattacactataaaaaagaaatcatttccttattactggaaaccacgcctattaaagctaaccatttgcgaagcatactggattatattgaacaggaacagttaactgctgaagatcgtaaccattgtatgaaactgtctaaaaaaatccatagagaaaaaaactatacacccaacagtaaatctcaatggtagtgcatgttttttgcaatctccttctgacgctattttttgtcgccatctgtcattgcaatacgcccttgattcattgagaaatggaaaaggcaaagtcaacctgattaaacattactcctccgttgaatccatacagcagcatgtccccttagtccgggacgcggagttcagagcattacttcgccatcctcctgcagggagtcgcgttatcgcgagtaaggattttggcttcgctttagatattttcttttgtcgaatgatggcaaacaatgtcagtcatatgtccgcgattttatatatagacaatcatactttgtcagtaaggctacgaataaagcagtcagtgtatggacaattaaattatgttgtgtccgtttacgacccgaacgataccaacgttgccgtcagagacacccacaggacagcacggggctttctttcgcttgataagttcatcagttcaggtcccgatgctcagacctgggctgatagatatgttcgcaactgtgcaattgctattctgcccctattacctgtgggagttccaggggctattttcgcgggtattgcatcacgaatgccatttgcccctatacatccatcggcaatgttgttaataatggctacaggccagtctcaacagcttattacattattcaaacagttgcccatactccctgaaaaagaaatcattgaaataataactgcgcagaatagcgttggtacacctgctttatttttggctatgatgaacggacatactgacaacgtgaaaatatttatgcaagaaattcagtcactggtagataatcacatcattcatgaagataatctggttaaattactgcaaactaaaagtgctaacgaaacacctggactttatatctccatgttgtatggattcgatgaaataatcgatatctttctgaatgcattaaccactccaatagcacaagagcttttaaacaaaaaactggtgatgagtattttagccatgaaaatacatgatggtgagccaggattatacgccgcaatggaaaataatcaccctttgtgtgtcacacggttcctctctaaaattaatggcatcgcctttaaatacaagttgagcaaagctaacatcatggatttattaaaaggagctacagcacagggaacccctgcattatacatcgccatgagcaagggtaatgaagacgtcgtgttatcttatatatcgacgctgggtgcttttgcaaaaaaacattcttttagtcaacatcagttatttacactattggccgctaaaaatcatgacaacatgtcagctgttcatatagccattcatcataagcattataaaactgtagaaacatattatgctgctattaatgcaatcagccaaagcctgagttttagtgctgatgaaataaagacgtatttataaccagctatttacgatatatatcgatacataattttatttttttcataaaacgcagaaacagtgaccatgtgcacaacgccacccgacggctgtaataacaaaaaatcccttgatgcctgtcccttttgttacactccgttatcacgcacaagagatatgcaggacactggtatgccgactaaacgctttgataaaaaacactggaagatggtggtggtgctactggcaatctgtggcgctatgttgttgctacgttgggcagcaatgatttggggctgagcagtgacaaacgaagacagccagaccgcataacacggtccggcagataattttacatgctgtagcccagcgataaggttgtccgacggtcggtatgttccggtgcagactctggaggttcagagttccatgtgacgttgtaagccaccttcagtccaaaatgttcattaatagcaacatttaatgcgctttcggagttcagcgttgtgtcttccgcgccaaagaccgaaacaccctgcgtaaatttagcgttgtcagtcaactgccatgcataagccccggaggcatagcccagcggctgggtttcactggcattgtcggtatatttgtcgtaacgcacacctggaccgaattcaaagcggaaactgtgtaccgggccattcaaaaactgacgaccataacccgcggtcaacacatcgcgctctcgatagccgttataacggtctgtcagccagcttgcctgaccaaataaatagtcataatcagttaaattaaaacggctacgcccgcccgccgcatatttttctgaagaacgctcatcattagaagaagtattactggcgttcccccacagcgaccaggcagtggtgtgtccataccaggtcatggtggtgtcagccgtaagtgaggagcttttcgtattgcctgattgtgcaagatatcctgcgttcagattaccttcgaaaggttttttagcgctggcaggatcatccatgacagtaaaaacggaatcatcggcagctgcattcagtgacgcaaacatgccccccgccaacataacgatggcaggaactgtcttcaaaagcttcatttatcaagagtccgtacaacaaaaaaagagaccatcgcggtcccggaaactttcttaaggatcaaagattagcgtccctggaaaggtaacgaattataaaaaggcgcgaataacttagcaatgtattcttatttcattttttgaataagcatgtggcgaaaacagatttttatttatatatatttatctgcaaaattttaaataaagctccaataaatcatattgttaatttcttcactttccgctgattcggtgccagactgaaatcagcctataggaggaaatgatggtacgtatctatacgttgacacttgcgccctctctcgatagcgcaacaattaccccgcaaatttatcccgaaggaaaactgcgctgtaccgcaccggtgttcgaacccgggggcggcggcatcaacgtcgcccgcgccattgcccatcttggaggcagtgccacagcgatcttcccggcgggtggcgcgaccggcgaacacctggtttcactgttggcggatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccatcctggtcataagcggaagcctgccgccaggtgtgaagctggaaaaattaacccaactgatttccgctgcgcaaaaacaagggatccgctgcatcgtcgacagttctggcgaagcgttaagtgcagcactggcaattggtaacatcgagttggttaagcctaaccaaaaagaactcagtgcgctggtgaatcgcgaactcacccagccggacgatgtccgcaaagccgcgcaggaaatcgttaatagcggcaaggccaaacgggttgtcgtttccctgggtccacaaggagcgctgggtgttgatagtgaaaactgtattcaggtggtgccaccaccggtgaaaagccagagtaccgttggcgctggtgacagcatggtcggcgcgatgacactgaaactggcagaaaatgcctctcttgaagagatggttcgttttggcgtagctgcggggagtgcagccacactcaatcagggaacacgtctgtgctcccatgacgatacgcaaaaaatttacgcttacctttcccgctaacaaaaacattcccccagcattgggggaatcatcaccaacctgtcggcaacgcgtttctccgactatgctcaaaagtcatgtgataacaaaggggtgaactatggccagtggcgatcttgtccgttatgtcataaccgtcatgttgcatgaggatacattgactgaaattaacgagttgaataattacctgactcgcgacggttttttgctcactatgacggatgatgagggaaatatccatgagctgggaactaacacttttggacttatcagtacccaaagtgaagaagaaattagagaactggtttcggggcttacccaaagtgcaaccggcaaagatcctgaaatcaccatcacgacctgggaggaatggaatagcaacagaaaataaatggtttttgggcaataatcagtctgtggtgtgcgttagctcgtgtttttacaccgcattcttgcgctaaccttatgatctggcagacaacatgggagagacatcatgtggcaggcaatcagtcgtcttttgagcgagcagttaggtgaaggcgaaatcgaactgcgtaatgaactgcctggcggagaagtccatgccgcatggcatttgcgctatgcaggacatgattttttcgtcaaatgtgatgaaagggaactgcttcccggttttaccgccgaagccgaccaactggagttactgtcgcgtagtaaaaccgtcaccgtgcctaaggtttgggcagttggcgctgaccgtgactacagttttctggtgatggattatctcccacctcgtccgctggatgcgcatagcgcatttattcttggtcagcaaattgcgcgtttacatcaatggagcgaccaaccacaatttggccttgatttcgataacgcgctctccacaactccacagcccaacacctggcaacgtcgctggtcaacgttttttgctgaacaacggattggctggcagttggaactggctgcagaaaaagggatcgctttcggcaatatcgacgccatcgtcgagcatattcagcagcgtctggcctcacatcaaccgcagccttctctgttgcacggcgatttatggtccggcaactgtgcactgggtccggatggcccgtacattttcgacccggcctgctactggggtgaccgagagtgcgacctggcgatgttaccgctgcatactgaacagccgccacaaatctatgacggctatcagtcagtatccccgctacctgccgatttccttgaacgtcaaccggtttaccaactctacacgctgttaaatcgtgcaaggttatttggcggtcagcatttggttattgctcagcagtcattggatagattattagcagcatgatatgggttgaggataatggccgctccgtgcggccttttgattaaataaacccaagcagagaaaagaacacataacctgcagcaatacaaataaccggcaggatatacagtgagaaaaactgcaggaaaatagtatggtgcggaacaacaatacgggactcaatttgttcacgcgttagcccctcttcccctttggctttttccagaatgagttgatcttcaacaccttcccgcaagaagcgcgcctggcgactcatccgggcaccggaatcctgcaacgccagtccgacaaaaatcaggatgaaaatcacccagaacataacgttcacgccaccattaaaattgggcgtcggggagttataccagaatagattcaaaaaaggcgtattcgcctgcatcatatcgatcatgacatgagtaaagtcgagcatgaccgcattaatgccttccttgttttcctgccgggtattcataaatttcagcaaagaaatcaatgtagagatcaatgcaggtataaaaatcacccaacccaaaatccttttcaaaacagcaatgcgtccagcttgttgatacgtcatgagttctccttgattaagacgcgtcgtttcacttagtttacctgtagatatctgttttcgcccattctttaaaggcgatatgataggcgcttaatcataagcacggcttaataccttacacataatgctctaaaggagaggttgtaatgtcaaccccgcgtcagattcttgctgcaatttttgatatggatggattacttatcgactcagaacctttatgggatcgagccgaactggatgtgatggcaagcctgggggtggatatctcccgtcgtaacgagctgccggacaccttaggtttacgcatcgatatggtggtcgatctttggtacgcccggcaaccgtggaatgggccaagccgtcaggaagtagtagaacgggttattgcccgtgccatttcactggttgaagagacacgtccattattaccaggcgtgcgcgaagccgttgcgttatgcaaagaacaaggtttattggtgggactggcctccgcgtcaccactacatatgctggaaaaagtgttgaccatgtttgacttacgcgacagtttcgatgccctcgcctcggccgaaaaactgccttacagcaagccgcatccgcaagtatatctcgactgcgcagcaaaactgggcgttgaccctctgacctgcgtagcgctggaagattcggtaaatggcatgatcgcctctaaagcagcccgcatgcgttccatcgtcgttcctgcgccagaagcgcaaaatgatccacgttttgtattagcagacgtcaaactttcatcgctgacagaactcaccgcaaaagaccttctcggttaatgaccaggggcagtgatctcgctgcccctggttctttatctgaaattgcattcaactgacggattaatcgtcaatttaagagaaagagttacaccgtcaccacttccgtgcactgtataaaaatcctatactgtacgtatcgacagtttagtgagttttatcatgacggcggaaggtcaccttctcttttctattgcttgtgcggtatttgccaaaaatgccgagctgacgcccgtgctggcacagggtgactggtggcatattgtcccttccgcaatcctgacgtgtttgttaccggacatcgatcacccaaagtcgtttcttgggcagcgattaaaatggatatcaaaaccgatcgcccgcgcttttgggcatcgtggttttacccacagtctgctggcggtatttgcgctgctggcaaccttttaccttaaggttccggaaggctggttcattccggctgatgcgctacaaggaatggtgctgggttatttgagccacatacttgccgatatgctgacacccgccggtgttcccctgctctggccatgccgctggcgtttccgcttgcctatcctggttccccaaaagggcaaccaactggaacgttttatctgcatggcattatttgtctggtcggtatggatgccccattcattacccgagaacagcgctgttcgttggtcatcgcaaatgatcaataccttgcagatccagtttcatcggcttattaagcatcaggttgaatactaaaaaggcaaaaatcacctttctggaataagcaattccatttgaatataagagccagctcacagttctgttaatcttgcgccaacactatgactgctacgcagtgatagaaataataagatcaggagaacggggatgaactttccattaattgcgaacatcgtggtgttcgttgtactgctgtttgcgctggctcagacccgccataaacagtggagtctggcgaaaaaagtgctggtgggtctggtgatgggtgtggtttttggccttgccctgcataccatttatggttctgacagccaggtacttaaagattctgtacagtggtttaacatcgttggtaacggctatgttcaactgctgcaaatgatcgttatgccgttagtcttcgcctctattctgagcgcggttgcccgtctgcataacgcatctcagttaggcaaaatcagttttctgaccatcggtacgcttttgtttaccacgctgattgcggcgctggtcggtgtgctggtcaccaacctgtttggtttgacggctgaaggtctggttcagggtggtgcagaaactgcacgtctgaacgccattgaaagtaactatgttggtaaagtctctgatctgagcgttccgcagctggtcttgtcctttatcccgaaaaacccgtttgccgatcttaccggagccaatccgacgtcaattatcagcgtggtaatttttgccgcattcctcggcgtagctgcattgaaactgctgaaggatgatgcgccgaaaggtgaacgcgtcttagccgctatcgataccctacaaagctgggtgatgaaactggttcgcctggtcatgcagttgaccccttacggcgttctggctctaatgaccaaagtggttgcaggttctaacttgcaagacatcatcaaactgggaagtttcgttgtcgcgtcctacctcggtctgctgattatgtttgcagtgcatggcattctgctgggcattaatggcgtgagtccgctgaagtacttccgtaaggtatggcctgtgctgacgtttgcctttaccagccgttccagtgctgcgtctatcccactgaatgtggaagcacaaacgcgtcgtctgggcgttcctgaatccatcgccagtttcgccgcctctttcggtgcaaccattggtcagaacggctgcgccggtttgtatccggcaatgctggcggtgatggttgcgcctacggttggcattaacccgctggacccgatgtggattgcgacgctggtcggtattgttaccgttagttccgcaggcgttgccggtgtcggtggtggtgcaactttcgccgcactgattgtactgcctgcgatgggcctgccagtaaccctggtggcgctgttaatctccgttgaaccgcttatcgacatgggccgtacggcgttaaacgttagtggctcgatgacagctggcacgctgaccagccagtggctgaagcaaaccgataaagccattctggatagcgaagacgacgccgaactggcacaccattaattcttatgctggcaacggtccgttttgtataggggccgttgccttactttttaaatgttccatcgcggcgatgcatactgactcatatttaaacagatcgtcagcgaaaaaaatgtccaacttatcaatacattcctggctcaatgaatgtgcctgtagcgagaagcttaaaacctcatacccgagacgttttctaagtgaactatctggaatactcataatatcttcaagcacaccacttcccattcccggaagatttagtggattaaaaagaagattgatattaagcattgatattatcgaaggaaactttaggagactctcatttttttgaatcgcagcaaaaatgctcccgacaggatgtatataattttgttcatagtatatagtccttaaatagtgaataaccaacctgttttttatactgatcaaattggtcattttttctgggcgaaatacagaagtgacatccattccaataaaatctttatttatacctcttatccgaatttcactaccataaagattattaattattactctatatttaacattgtcctgcagatatgtatcaaaactaagtgctggcgctcctggctttgaggcatcatagttaatgttagacatataggcaatcatataattaaagtttgattctgctatttcatcgcagtcacattgacccgttgatataaagaaagtgagtgctgtcatagtagactgcagcctttctttaaaagagtcgaaagccaggcttttaatatttaaatcaccataattactctgtattaagtttgtagaaaacatctcccgcctcatattgttaacaaaattattatctcatttaaatctaagtcatttacaatataagtttaagagcgacgccacaggatgaactatcaaaaatagctcatcatgattagcaaaacttaaccattttaaaataaataaacaattaaagaaaaaagatcacttatttatagcaatagatcgtcaaaggcagctttttgttacaggtggtttgaatgaatgtagcaacgaaatacagaatttcaggtcatgtaactcccggcaaaaccgggaggtatgtaatccttactcagtcacttccccttcctggcggatctgatttgcccaacgttgggcagattcaggcacagtaaacgccggtgagcgcagaaatgactctcccatcagtacaaacgcaacatatttgccacgcagcatccagacatcacgaaacgaatccatctttatcgcatgttctggcggcgcgggttccgtgcgtgggacatagctaataatctggcggttttgctggcggagcggtttcttcattactggcttcactaaacgcatattaaaaatcagaaaaactgtagtttagccgatttagcccctgtacgtcccgctttgcgtgtatttcataacaccgtttccagaatagtctccgaagcgggatctggctggtggtctatagttagagagttttttgaccaaaacagcggccctttcagtaataaattaaggagacgagttcaatgtcgcaacataacgaaaagaacccacatcagcaccagtcaccactacacgattccagcgaagcgaaaccggggatggactcactggcacctgaggacggctctcatcgtccagcggctgaaccaacaccgccaggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaacgctgctggaagattttattctgcgcgagaaaatcacccactttgaccatgagcgcattccggaacgtattgttcatgcacgcggatcagccgctcacggttatttccagccatataaaagcttaagcgatattaccaaagcggatttcctctcagatccgaacaaaatcaccccagtatttgtacgtttctctaccgttcagggtggtgctggctctgctgataccgtgcgtgatatccgtggctttgccaccaagttctataccgaagagggtatttttgacctcgttggcaataacacgccaatcttctttatccaggatgcgcataaattccccgattttgttcatgcggtaaaaccagaaccgcactgggcaattccacaagggcaaagtgcccacgatactttctgggattatgtttctctgcaacctgaaactctgcacaacgtgatgtgggcgatgtcggatcgcggcatcccccgcagttaccgcaccatggaaggcttcggtattcacaccttccgcctgattaatgccgaagggaaggcaacgtttgtacgtttccactggaaaccactggcaggtaaagcctcactcgtttgggatgaagcacaaaaactcaccggacgtgacccggacttccaccgccgcgagttgtgggaagccattgaagcaggcgattttccggaatacgaactgggcttccagttgattcctgaagaagatgaattcaagttcgacttcgatcttctcgatccaaccaaacttatcccggaagaactggtgcccgttcagcgtgtcggcaaaatggtgctcaatcgcaacccggataacttctttgctgaaaacgaacaggcggctttccatcctgggcatatcgtgccgggactggacttcaccaacgatccgctgttgcagggacgtttgttctcctataccgatacacaaatcagtcgtcttggtgggccgaatttccatgagattccgattaaccgtccgacctgcccttaccataatttccagcgtgacggcatgcatcgcatggggatcgacactaacccggcgaattacgaaccgaactcgattaacgataactggccgcgcgaaacaccgccggggccgaaacgcggcggttttgaatcataccaggagcgcgtggaaggcaataaagttcgcgagcgcagcccatcgtttggcgaatattattcccatccgcgtctgttctggctaagtcagacgccatttgagcagcgccatattgtcgatggtttcagttttgagttaagcaaagtcgttcgtccgtatattcgtgagcgcgttgttgaccagctggcgcatattgatctcactctggcccaggcggtggcgaaaaatctcggtatcgaactgactgacgaccagctgaatatcaccccacctccggacgtcaacggtctgaaaaaggatccatccttaagtttgtacgccattcctgacggtgatgtgaaaggtcgcgtggtagcgattttacttaatgatgaagtgagatcggcagaccttctggccattctcaaggcgctgaaggccaaaggcgttcatgccaaactgctctactcccgaatgggtgaagtgactgcggatgacggtacggtgttgcctatagccgctacctttgccggtgcaccttcgctgacggtcgatgcggtcattgtcccttgcggcaatatcgcggatatcgctgacaacggcgatgccaactactacctgatggaagcctacaaacaccttaaaccgattgcgctggcgggtgacgcgcgcaagtttaaagcaacaatcaagatcgctgaccagggtgaagaagggattgtggaagctgacagcgctgacggtagttttatggatgaactgctaacgctgatggcagcacaccgcgtgtggtcacgcattcctaagattgacaaaattcctgcctgatgggaggcggcgcaattgcgccgcctcaaatgatttacatagtgcgctttgtttatgccggatgcggcgtgaacgccttatccggcctacaaaactgtgcaaattcaatatattgcaggaaacacgtaggcctgataagcgaagcgcatcaggcagttttgcgtttgtcagcagtctcaagcggcgcagttacgccgcctttgtaggaattaatcgccggatgcaaggttcacgccgcatctggcaaacatcctcacttacacatcccgataactccccaaccgataaccacgctgagcgatagcacctttcaacgacgctgatgtcaacacatccagctccgttaagcgtgggaaacagtaagcactctgacggatagtattatcgataaacgccggatgacacatcacctccagcgaacgatcaccccgatggcctgcgtcatccagcacttgcaggaacagcgactcactgatctcttcaccgtagaatgcactgctgaatccctgggtagtgcgcaggttgaccggcaaatcaaacgccatctgacgatccgcccgcaacgcaatgccctgctctgccgcaaacctggcaacaatcgggaaaatctgcgggaacatatgcacatgatgatggctatcaagatgcgtaggtttgcgtccaaatagctcaatgaaacgcaaatactgactgacaagctcctgagtaatttcttccagcggtaaagcatcttcttctgccaactgccagatccattttcccagcacaccatcgcgggttaaccccggcatagctgtcagtggcttacccatagtaaggacaaagtgcatccctatggccagactcggttcatcacgactcaactgcaccgcatggtcaatagcctgcccattcaccagcgccgtcgtcgacgtgacaatcccattgcgacaggcctcgataatgccgtagttctgacctttgcttaagccaaaatcatcggcattaacaatcagtaagcgttccataatcagcctcggttaatgtgcttttttaagctctgcgatgcagtcggcaaagtttggcagccatttctcgtgcgccagaatcatctcgcgtgccagcagctcagcatcgcgatcggaatgcaccaacggactaaggtttagcgccagtaacacatcgttaaattctccgctaagtgcggcgttactggcagcaatctcgaagcctttaatggtgtgaatcagccccattactttatcatcgaaatgcgtaatgcgcggatgtggcgtcgcgccatcgcgccccagcttacaggtcatttctactgcccagtctgccggaatattatcaatctgcccatgatgcgggatattaacgtaatgttctgcttgcttgtcgttgtagatagcgttgatcacttcgcatgctgcatcagagtaataagccccaccgcgctgttccagttctttcggcttaactttcagctcaggatttttatacagctcaaaaagttgtttctcgactttctgtactacctgcgctcgtgcgccgcctttgtagtattcgcccatttcaatagccagcatctctttctgcttgaagtaatacagcagataagaacatggcagcagattcaacgaacgaattaagccctcactaaatggcagatcgaaaatattttttacagaggacgcttttaactgccctgacgccacaccatcaagcaattcggcaaagcgcgacttgccatttatcagcacatccttaatgaacaccatatggttgaggccgaacaaatcgatagataaatcatcgctgtctttcagcatcagaacatcgcgaataaacatcttcatgccgatcggaatattacacacgccgataaagcgtttaaatccggtatgacgataaacggcttcagtgaccattcccgccgggttagtgaagttaatcacccatgcattcggacaaagttcttcgacatcttttacgatgtcaaaaatcaccggaatggtacgcagacctttaaacaaaccgcccgcgccgttggtttcctgaccaagataaccatgacttaatggaatacgttcatccagttcacgcgccggtaattggccaacgcgcagttgggtagtaacgaaatcagcatctttcaatgcttcgcggcgatccagcgttttataaagcttcatcgggacgccagcgttatcaatcatccgttggcagagatcgaaaataatatccagtttcggtttaccaccttcgacatccaccagccataattcgctgaccggcaattcgtgataacgcttaataaatccttccagtaactccggggtatagctgctcccgccaccaatagtgacgacttttaatttctggctcataatttctcccttcagtacagaatactgatatctggcatatctgcccccccggacataaataatccagcaacaggacagatatgtgaattgtcaggtataacgacttactgattaaattcagtcaatttcttacgatagctcttaggcgtaaaggacgttaatttcttaaacgttttaataaacaaactcgggctactataaccggcctcaaacgcaatatccgtcactgaatagttggtcatttccagttgttttttggcaaaattaatacggatttcattaataatctgcattggcgttttgccataatatcgttgagtcgctcgcgtcaaatattcctgtgatttggctgacaacgccaccatattctccagcgccgattcactaaactgctctttatcatgcatcttttctaccgtacttttcagccactgcggtacatcatcaatcacctgttcttcgcggtaatgacgtaaacggttaatgacataaaaagtaaccatctcaacaaactcttccagccctgtttcgcggaaattcaatgaagaaatcactgtttccacataggtgagaaaagcgttattggtccggtatacctgcgaagcgacaaagcaataaggcaacaatggcaggtaatgctgctcaaaaaagcgtttactgatcccaacgttcaatatgcgcgtggcaccaaactcataaaaactttgatggtgcgaacctaacggaataaaaacaaaatcgccccgttccagtaacacgcgcttaccgttaatctcctggaaataacgcccggttaataccagagtaaattcataatagtcgtgctgatgcagtccgctgatactctcagttttgttatagataaacacatggaagtttttgccattaaacaactgctgttctcgggcagtggcaatttccggcgcgttaatcactggctgcatcatcgactccttatgccttcagtttttcatgaagctcaattaattcagtaatcagttcacgcgcaagcatggacgtcattaaatgatcctgagcgtggaccagcaccagactcactttcatcttaccttcgcccgcatcgccttcaatcagtttcgtctgtaccagatgcgcttcattcaatgccatccgtgactgatccatcatggcttttgctgcggcaaaatcgccctgcttcgcctgtttcagtgccgcatacgccaggctgcgcgcttgtccggagttgatgatcagccccatcaccacttcttccagctcttcagcttccgtttgcgtatcgggaatgttatcgagatccatcatacatcgttcctctcttttcttaccggcacgattacccgtaccggcatcgattaaaatttcagggcgttagcgatatcttcttcgctctcttctttatcaatcgcattttgtgctttgttagccaccacaacaaagggcagataaattaacgttgcgatgccaaggttgaagagtgcgaccagcaatgcggcgacgctaccgttggtgttaaagaaggctcccagaccggttggcatggtccacggtgcaatattggtcaccggaggaataatgcccatgtagtacgctgcgagggtgattgccgccagaatcggttgtaccagtacaaacgggataaacatcaccgggttcatgataattggcagaccaaacagaatcggttcgttaatctggaagatgccggacggcagcgccagttttgccacctgacgataatcagcacggcgagaggcgataaagatagccaggatcaggcctaaagtcgcaccactgcccccaaggaaaataaaggagtccagcatcggcttggcccagatatggaaggtcttaccggctgccagcgccgcttcgacggaaccatattgctgataggtcgcgatattttccagtgcccacggcgtcataatgccgttgtccagtgcggtcagcgccagcgcgccatgaataccgaagaaccagagcagtggaacaaagatcacataggcccagcccaccacgctacccaacgatgccagtggggttgagatggtatccataatgatctgatggaagttggtgccccaggtattcaacgcccaggcaataatccccatcacggaaagaataataaagccgggaattaatgccgagaaggaacgcgatactgaagcaggtacgctgtcgggcagtttaatgacccaattgcggcggacaataaaggtaaacatttctgccaccaccaggccaataataatcccggagatgatattcgccccacctaaccagtttgcaccaaccgcataggcctcaccgacactatatggggtgacggtcataaatgctgcaacggataacaacccagccgccagcgcatcgactttacgctcttctgccagcgccatgccaataaagaacggtgccattaaagacattattcctaatgttccgttatatacgttgccgccaatacctttcagaccattaagtgtttcaatggttgaggcgtcgaggcgaatacctaaggaataaaaaaacgacccctccccaaagcttagaaaaacgttgttaattaatacaaacatggcccccgcaagggttaacggcattaagcgaataaagccatttttgattgcattaacgtgtggctgctttcctattttaactgcaaaagggaggagtaccttttcaagcgatgcaataacattactcatagaaaaatacccttaaaaaccgcaatttaaatattgcggtattgatttatgaaataactctttgacgggaaaatttaaaataaattaatttgctgcggcttttttaatcgctgcaaccgcagccttaagcacgcctaaaccatcgactttgccataaagcagcgagtcaattacttcaaccggtttgttgggtaacaaacgctggatttcgggcaacatataagcaatctgcggccctaataacacgacatcggcattctgacctttttcaccagccagtgtttccggaaatgcttcaataatgaccggaacttcatatttttctgcctgtgcgcgcatttttgataccagtaaagaggtagacatgcccgcagaacaaaacagataaatgtgtttcttttccataaaactgccctcatcgacgattatctgtcagccagacactccgcaagccttaacctgcttccatgctctgggtaacttgcgaaaccaacatgactttttttgtggctgaaaggagtatacggtatagacctgagcaatagtatttctttgaccttataaattgtttctccttgacctgtggttatgaccctcttcacatttcgggcaaataattcgcgaagataattaagaactcaggccaaaaaaaaccggcgcaatggccggtttccgttgttactcaagctttcagacgaattgattacttcgcagcctgtggatcagtgtcgtattcagcacaggtctgataaccggagttgatgacatgtccggtatcatctaacgcgacaaagtaggtttctgctttaccatcacgttgacccaggatgtaggtctggcaagtaccgcgagcatggatcatgctcacttcagacgaaggtttacccgcaatttgtgcaacctgcgcccggctcatgccttttttgacgtctttcaccacaggctgtacaaactggtctttggtacgatcataagccgtacaacccgccagcatggttaataccgccgctgcactcagaattcctgccatattcttgttcatattccgtcctcttgtttatcagcgtgttagataagcctggaatacattgggcgctttttcaagcccgtgaacgaaacggctccgctttcagaggattcctgtatgacgttttaaccaccattcagcccgctgtcgcttgtcgtttcagtagcaacgggttagctttaaggaagttttgtcttttctgtctggaggggttcaatgacattgcaacaacaaataataaaggcgctgggcgcaaaaccgcagattaatgctgaagaggaaattcgtcgtagtgtcgattttctgaaaagctacctgcaaacttatccgttcattaaatcactggtgctcgggatcagcggcggtcaggactccacgcttgccggaaagctgtgccagatggcgattaatgagctgcgcctggaaaccggcaacgaatcactgcaatttattgccgtacgcctgccctatggtgttcaggccgacgaacaagattgccaggatgccattgcctttattcaaccggatcgcgtattaaccgttaatatcaagggcgcggtattggccagcgaacaggcattgcgggaagcaggcattgaactgagcgattttgtccgtggcaatgaaaaagcgcgtgagcggatgaaagcacaatatagcattgcgggtatgaccagcggtgtcgtggtgggcaccgatcatgcagcagaagccattaccggattcttcactaaatatggtgacggcggtacggacattaatccgctgtatcgtctcaacaaacgtcagggtaaacagttactggcggcattagcttgcccggaacacctttataagaaagcgccaacggccgatctggaagatgatcgcccttctctgccagatgaagtggcactcggcgtgacctatgacaatatcgacgactatctggaagggaaaaacgtacctcaacaggtcgccagaacaatagagaactggtatctgaaaaccgaacataaacgccgtccgccaattaccgttttcgatgatttctggaaaaagtaataatttgcacatattggattgtgcgaaaaagagtaatttgttcacgccggatgcggcgtgaacgccttattcgacctataaaactatgcaaattcaatacattgcaggagtcgaataggcctgacaggcgtagcacgtcagacggtgtaacctttgtcatcgacccgcctcttttttaatcgcttcccgcctgttacactggatagataaccagcattcggagtcaacagtggtacggcgtttaacttctccgcggctcgaatttgaagctgcggcaatttatgaatatcccgaacatttacgttcattccttaatgacttacccacccgaccaggggtgtatctgtttcatggtgaaagtgacaccatgccgctctatatcggcaaaagcgttaacatccgcagccgcgtcctttctcatttacgtaccccggatgaagccgccatgctacggcaatcccgacggatcagctggatatgtaccgccggtgaaatcggcgctctgctccttgaagcgcgattaatcaaagaacaacagccgctgtttaataaacggttgcgccgcaatcgccagctctgtgccctgcaattaaatgaaaagcgcgtcgatgtggtgtatgccaaagaggtggatttttcacgagcccccaacctgtttggcctgtttgccaataggcgcgcagctttgcaagcattgcagaccatcgctgatgaacaaaaactttgttatggcctgctgggactggaaccgttaagtcgcggtcgtgcatgttttcgttcagcgctaaaacgttgcgccggagcatgctgcggtaaagagagccatgaggaacatgcgctacgcttgcgccagtctctggagcgtttgcgggtggtgtgttggccttggcaaggggcggtggcgctgaaagaacagcacccggaaatgactcaatatcatattattcaaaactggctgtggctgggggcggttaattcgctggaagaagcgacaacgttaattcggacacccgccgggtttgatcacgacggttataaaattctttgtaagccgctgctttccggtaactatgaaattactgaacttgatccggcgaatgaccagcgagccagttgatttcactgaacaacagtttaccttgcggttgtaaaagccgcagggtgtgcctgccatcgaaccagcacgcgccctggtcggtagtgagcaatttatcgcccagttgccacgccccgttaatcacaaacaccaccccgccgcgtgagccaaaggtagtaaacgtacgttcggcaattctgactttcgccttacagacatccaggcgtgtcatgatgttgaaatccatcgacatctgccctgccgtcagtttcgcttttaccacctggtccgctgcaaaggcaaaaggctggaacggttttaaggtatggttaaagcggtctgcgctttcaaggagcatctcgccgccttccagcaacgtcactatcctttccatgccgggaaacaaagaaaactccccattcgccgcgatggatgcaatgctggcacgccagtaaaaatcacgttttgccggtgggaacgtgcaaatttcgcgcgtttcaccggcagcatttcgccacagattcaccgacattttacgcatatcaaagtattccatactcgctcccggcccgttcttttcattgttatcgttcaggtaaccgtggatggttatcggcaactcgggtgatttacgttagtggtgatcaggctttttttacaactgtttgagaagagaaaagaaaaccgccgatcctgtccaccgcattactgcaaggtagtggacaagaccggcggtcttaagttttttggctgaaagattattcagcagttgcaggcattttaccttttgccgctggacgttctgtcagacgcttctcaaaattagcattaaattgctttttctgttccggcgtcaggatgttgtaaattttgttctgggtttccatgtgcgccagcatgttagctttgcgctgttcttccatttttgcgatctgcgcttcagcttttactttatcgaaggtatcgctggcaatgatgtcatgcattgcgcggcgttcttccagcggcggacgtttcatctggtcacgctggcctttcatgatttcgcggatctgctgtttctgcgcgtcggtcaggttcaggtctttgaacatcatgtcctgatgcggaccgaacttgcctttgtggtgcatcatcggcttcgcgtcagccggtgctgcggtagtggtgtctgcggcatgggccaggttagccgcgccaagagccagggtagaggcaacaaacagtgcagttaatttacgcatattctatatccttcctttcagttatttattacggctttcttaagtagcgtgccgtgttgacgagattaactttactgactttagcgtcaattaatcagagcaacggtaaaacaatgaaagtgtaaaaaacacttttgcgccaattatggagaaaaaaagaaaatttgatggagagtgatgagagaatattacaacacgatgattttgcagagattatgaagaactataccggatgactggtgataaataaagcaaataaccaggattaatctgtattaatttataagaaagcaacttaatacccgcagaatgatttctgcgggtaagtattagcttattttttcgagcattaatcccgcgcgtaatcccaacgctaccaacggattagggaataacacatactctacatcatgggttacggtaaaacgttcctctccgtcctgcgccagcaatgttcctttctcaaacggcataaaattcagcgtgtcacttgccatatgcatttcgaaggacggcgagtggcgagtaatttgcgaaaccacccgataacggagcggcggtgttctcacgataccgacactctcaccagatagcagcgcagcaattgcgctggcagttactgcaaactggcgaagatcgttttgcccaaagggcaacgctttgccaagttccagcgtacaggccagcgcgccaaaatgtctggcgctgaaatgggtaaacgtaccaccaggttcctgatggaacaccagcgcctccagccccgccgcacccagccacgtcagaaatttctcgtcccagggaatgtcgcgttgcggtaatacaccgaactgcggatgcaaggagccacgaattgcggtatgtagatcaaggtgccagcgcacagattctttgccctggtcataaaaatcttccaggcactgttccagttcgcgcgcccgacaggtttctccgctttcagcaaatagctgccaacgaccgccaaacattcgattcatatcgctatggcaataacgtttcccttgcttcagcgcaggaggattcccgaggatcaccagcaaccgccaacgtaacgggatctcgccgtgagatatcgcgccaagcaacgcgtccagcatctccacaggtgccgtctcattaccgtgtattcccgctgaaatcaccagtgcgccttgcggtggcgttaatggcgtcagttccagcacaccatcgcccagccagcgccagcgaacgccgttgatttctcgctcggtgataaccggttttttacccgttaaggtcagagcaagaaaattatccattgccccctccctcgcgctggaacggataaaccgaaccgagattcagtaattggctcaatacatccagtgcttcccgcccttcgcgcagcaattgcgggtcggccagatcggcagcagtaaggcgatcgcggtagtaacgatccacccagtcattgagcgcattaaacagcgtatcgttcatcatcaccgccggattcaccgcccggcgttcttcttctgtcaataccacccgcaaccgcaggcacgccgggccgccgccattcgccatgctttcacgtaaatcaaagacttttagttcgctaatcgggttgtcagcggcaaggagttcattgagataaccccatactccggcgtgttcccgacactcctgaggcagcaccaacatcatggaaccatcatcgcggctcagcagttggctgttaaacagataggtagacaccgtatcagacacggaaacctgagttgccggaacttctatcgccataaaaccattgacccgcgcacgcaggtttgccagtaactgtgactggcgagcgaacgcctgttggtggcaaaacagcacctggcggttactcacggcaatcacgtcattatgaaaaacgccctggtcgataacgtccgggttttgctgggcgaaaatcacctgttggggattcacctgattcagccttgccaccgcctcgctggcttcgcgagtctgtcgcgccggataacgggaaggccgggtatcattgccttcttctcgcccgtagacaaaaagttgcatacccggttcaccgtaatgaccgccgagacgattgtggtttgccgccccctcatcaccgagcaacgctacctgtggcaacgccgaatggacgctaaatttctcttcgtcgttaaaaatcgcttttaacagcgattcagtgacgggcgcttccagcgaacggtgaaatttattgttcaggttggcaacggtgagatgcactttgccatccagcgtatcggcagatggcgcgatcgttgccgcattggctacccacattggcgaagcggaactgacgctggaaagccagtgcggtgcctggcgtgcaactttttccagtacctgctcatcgctaccactgaatcccaactgacgcagcaccggaataaacggacgctcgtgcggcgggatcacggcctgggggaatcccgcatcggcaagggctttcattttcagtaagccctgcttcgccgccagtcgcgggttagacacctgaaaacggtgacgggtagaggcttcattaccaaacgacaggcccgcgtaatgatgcgtcagccctaccagcccgtcgaaattgacttcccaggcgttcatcgcaccacctcatcggaaaaatccagcccggggttaagcgtggcgggcaatgttaacgagtccgactccaggctcgccatcggccatgcgcagtaatctgcggcataccaggcgctggggcgatggttaccggaagcaccaatgccgccgaatggcgcggtactggcagcaccggtaagcggtttgttccagttaacaatccccgcccgcgcctccagcaacagttgatcgaacttttcccgctcgggggaaaccagaccgcaagagagtccgaagcgagtgttattcgccattcgaatcgcttcatcgaaagtatcataacgccagacgcgcaataacggtccgaacacctcttcatctggtacgccagcaacgcctgtcatttcaatgatccccggcgtcagcaacgatgtccctgcttgtaataagcgcggcgcaagcaggggtcgtccgcccatcgcttccagttgctgccatgcagtaaccacctgctgtgcggcctgttcagaaatcagcccgccaataaacggctgcggttcgtcatcccagttgcccggcgttaatcgctggctgacggcaaccagacgagcaagaaacgcatcgccctgcgccccgcttttcagcaataaacggcgggcgcaggtgcagcgttgaccggctgtgacaaacgccgactgaatggtcagatggacagccgcgtcgatatccgccacctcatcgataattagcggattattaccgcccatctcaagggcgagaattttctccggctgaccggagagctggcgatgcaactggtagcctgtattggcgctaccggtaaacagcaaaccgtcgagatcctccagcgcactcagcgcctgacccgtttcacgcccgccctgcaccaggttcagcacgcctggcggcaagccagcctgctgccataaacgcattaccgcttcgccactccacggtgtcagttcgctgggtttaaagataatggtgttacctgccagcaatgccggaacgatatgtccgttcggcaaatgaccagggaaattatacggcccaaacaccgccagcacgccgtgcgggcgatgtcgcaggctcgccgcgccgtccggcatttcactacgctgctcgccggtacgaacgtgatacgccttaattgatatcgcgattttattgatcatcgccgtcacttcggttgccgcttcccagcgcggcttacccgtttctctggcaataatcgcggttaattcggctttattgctttccagcagtgcggcaaagcgttcgacaacggcatgacgttcagcaaatgaaagccgcgcccagcgcggaaacgccgcacgggctgcccgacaagcctgctcgacctgagcggcatcggcatcattgccttgccataacacctcgcccgataccggattacgcttcacacgcgatgcgccctggcccgttatccagtcaccgttaatccataaagtcatgctgttttctcctctgcgcacaggcgcaccagacgaacgcgatccccggcgtggcatttgagggcatccagttgtgcggcggttaaaatcaaacgctcggttgccggatcggtacgcaccagcaccacgcggaaatggtgataattttcattggcgaccaggcaggctgggaaatcgccctgcgcaggctgcccttctgccacttccaccagccgacttttacggatggcgcgcacgcggtcgatgtcacactcaagcgtcggcccaccgtcaaagatgtcgatatagttacggtagcgaaaaccttctttctccagcaccgcgcgggcaggcgcggtttgcggatgtacctgaccgatgacgtcctgggcttcctgggataaaaagtgggtatagatcggatgtttcggcatcagttctgcaataaatgccttttgcccggtgccgcagagaaaatcggcgcggctaaaatccatcgaaaagaagcgtttaccgaggctttgccagaacggtgaatagccgtgttcgtcaatcaccccgcgcatttcagcaaccactttgtcattaaacttgtcgcgaaaagccgccataaacataaagcgcgatttcgacagcaaatagccgttgccctctttgcgccagtccgggtcgagaaacagcgtgcacagctcgctgctgccggtgtgatcgttactgagaaacagcgtcggcaatgcgttatagacattcagctcttttgaggcgtgaaccaacgtgccgacgcgatagttgtaccagggatcgttcagcccaaccgccacctcaatggcacaaatccccgccacggtgcctgtctcgctatcttccagcacgaacacatagccctgctcacttttgggcagttcgccttgccaggttttgattgccctttcgatacgcgccgaaagcgtggcttcattggcgggaagcgacgtcaggccgccgcccgttttgctggcaagctgcatcagcgccgagacatctgatcgctcaacgggacggatgaccatcatgatgaacctcggctaacaaagtgttcgcaagcagctgcaaagcgatccagtccggtcgtcacctcttcttcgctgacattgagcgcaggcgcaaaacgcaccacgttgccacccgcaatcagtaccatcacgcctgctttcgccgcttcctgagagatctgtttcgcttgcccggcgtaatcggcattcagtacacagccaatcagcaaacctaagccgcgaacttcactgaacaaaccatagcggtgattaatagtattaagacgctcaacaaaccagtcgtgacgctgtttaacgccattaagcatctctggtgtgttgatgagctccagcactttgcctgccaccgccgaggccagcggattaccgccataggtggtgccatgagtgccaacggtcatcacgcgggcgcactcttcggttgccaacaacgcaccgaccgggaaaccgccgcccagcgctttggcggtagttaacagatcaggcgtcacgccgtagtgcatataggcatacagttccccggtgcgcccgacgccggtttgtacttcatcaaaaatcaacagcgcattgtggcggttacacaattcacgcagaccttgtaaaaacgcgttgctggctggcaccacaccgccttccccctggatgggttcgacaatcaccgcacaggtagagtcgtcaatcagcgcgctggcagagttaatatcgttatatgcagcatgacgaatatccgccggcagtggcgcaaaatcctgtgaataggctggctgcccacccgcactgacagtaaacagcgtgcgaccatgaaacgcatttttgaacgccacgatgccgctcttatggctgccgtagcggtcgtgagcgaatttacgcgccagttttagcgccgcttcgttggcttccgcaccggagttacaaaagaagacgcgatcggcaaacgtggcgtcgatcaattttttcgccagtcgcagtaccggctcgttggtgtaaccgttgccggtatgccagaacttactcgcctgttcgttcagcgcttcacgcagttccggatgcgcatggcccagcgcgttcaccgcaatgccacccgcgaagtcgatatactctttcccctgctgatcccacaagcgcgaaccttcgccacgtaccggtataaagggtgccggagcgtaaacaggtatcatccattcatcaaagttttcacgcgtaattggctgagacatagcgacctctacagtaaataattcgttatttatatgttaataataagtaatgtttgcgctgtaaatgtagattgcagggttcgtgccagccagtgataaaagtgcataaacggcggaggctaactggaaatcaaggagttataaccaaaccatatgcatttaaagtgcatataaagtgaatacgtttgcgatgtgggtgaataaaaagaataaaaaacgcaatgttatgcagaagtaaaatataattctggaattgtgatcattgacgaaatttactggaaattactgcgccattctgacgcagcgcgcaccaaaagcgggcattttttgcgccatcgttgacatcattaacaaccatcgatcaaatcacttaacaacaggcggtaagcaacgcgaaattctgctaccatccacgcactctttatctgaataaatggcagcgactatgaaatttgtctcttttaatatcaacggcctgcgcgccagacctcaccagcttgaagccatcgtcgaaaagcaccaaccggatgtgattggcctgcaggagacaaaagttcatgacgatatgtttccgctcgaagaggtggcgaagctcggctacaacgtgttttatcacgggcagaaaggccattatggcgtggcgctgctgaccaaagagacgccgattgccgtgcgtcgcggctttcccggtgacgacgaagaggcgcagcggcggattattatggcggaaatcccctcactgctgggtaatgtcaccgtgatcaacggttacttcccgcagggtgaaagccgcgaccatccgataaaattcccggcaaaagcgcagttttatcagaatctgcaaaactacctggaaaccgaactcaaacgtgataatccggtactgattatgggcgatatgaatatcagccctacagatctggatatcggcattggcgaagaaaaccgtaagcgctggctgcgtaccggtaaatgctctttcctgccggaagagcgcgaatggatggacaggctgatgagctgggggttggtcgataccttccgccatgcgaatccgcaaacagcagatcgtttctcatggtttgattaccgctcaaaaggttttgacgataaccgtggtctgcgcatcgacctgctgctcgccagccaaccgctggcagaatgttgcgtagaaaccggcatcgactatgaaatccgcagcatggaaaaaccgtccgatcacgcccccgtctgggcgaccttccgccgctaatttagcagctctcctggctcaaactgggtcaggagaattaaccttgagaaaaatcaacaaactgtcagtaatgatttgttgcctgccgtcctttgttataccgtctctgcgtttttagttgtctgaccacttctctattatcaagtttgatataggaaactccacgatgaacgctgagcgtaaatttctttttgcctgtcttatttttgcgctggtcatttacgctatccacgctttcggtttattcgatctgctcaccgatttaccccacttacagacactcatccgccagagcggatttttcggctatagcctctatattctgttattcatcattgccaccctcttgctgttaccaggaagcatactggtgatcgcgggaggaatagtttttggcccgctcttagggacactactctcattaattgccgccacgctggcctcctcgtgctcattcctgctggcgcgctggctgggacgtgatttactgctgaaatacgttggccatagcaataccttccaggccattgaaaaaggcattgcgcgtaacggtattgattttcttattctgacccgcttaatcccgttgtttccttacaatattcaaaattacgcttacggattaaccacaatcgccttctggccttatacccttatttcggcactcacgaccctacccggtattgttatttataccgtgatggcaagcgatctcgccaatgaaggcattacgctgcgctttattttacaactctgtctggcgggcctggcgctgtttattctcgtccagctcgcaaaactctacgcccgacacaaacatgtggatctgtctgcttcgcgccgcagcccacttactcacccaaaaaatgaaggatagaacgatgttgcaacattattcagtgtcatggaaaaaaggactggctgcactctgtttactggctgttgctgggcttagcggctgcgatcaacaagagaatgcggcggcaaaagtggaatacgacggactttcgaacagccaaccgctgcgtgtcgatgccaataaccatacggtaaccatgctggtgcaaattaatggtcgtttcctcaccgacgacactcgtcacggtattgtgtttaaagatggctccaacggacataaatcgctgtttatgggttatgcgaccccgaaagcattttatgaagccctgaaagaggcaggtggtacgccgggcgaaaacatgacgatggataataaagaaacgactcatgtcacaggcagcaaactggatatttcggtcaactggcaaggggcggcaaaagcgtattccttcgatgaagtgattgttgacagtaatggcaagaaactggacatgcgctttggcggtaatttaacggcagcagaagagaagaaaacgggttgcctggtgtgtctggatagctgcccggtcggcatcgtcagcaatgcaacatacacttatggtgcggttgaaaaacgtggtgaagttaaattcaaaggcaatgcctcagttctcccggcggataacacgctggcaacggttacctttaaaatcgccgaataaagccaggataaaggatgatgatgatgcaatcgcgaaaaatctggtactaccgtataaccctcatcatcctgttgttcgctatgctgctggcatgggcgctgcttcccggcgtccatgagtttatcaatcgcagcgttgcggcgtttgccgccgtggaccaacagggtatagaacgctttattcagtcttacggcgcactggcggcagttgtctcgttcttgttgatgattttgcaggccattgctgcaccgctacctgcgtttttgatcacctttgccaatgcgtcgctgtttggcgcgttctggggcggcttgctgtcgtggaccagttcgatggccggcgcggcgctgtgcttttttatcgccagagtgatgggccgcgaagtggtggaaaaattaaccggcaaaaccgtgcttgacagtatggacggctttttcactcgctacggcaaacacaccattctggtctgtcggttattgccttttgtccctttcgatccaatcagctatgctgccggtttgacttcaatacgttttcgctcgttttttatcgccaccgggcttggtcagttaccggcaactattgtttattcctgggcgggcagcatgttaacaggcggtactttctggtttgtcaccggactgtttattctgtttgccctgaccgtggtgatttttatggcgaagaaaatatggcttgaacgccagaagaggaatgcctgatgggtttaccgccgcttagcaaaattcctttaattttacgtccacaggcgtggctgcatcgtcgccattacggcgaggtgctaagccccattcgctggtgggggcggatcccgtttatcttttatctggtgtcgatgtttgttggctggctggagcgcaaacgctcaccgctcgatccggtagtacgatcgcttgtcagcgcgcgcattgcgcaaatgtgcctgtgtgagttttgtgtggatatcaccagtatgaaagtcgccgagcgcaccggcagcagcgataaactgctggcagtggctgactggcggcaaagcccgctctttagcgatgaagaacggctggcgctggagtacgccgaagccgcaagcgtaacgccgccaacggtcgatgatgccctgcgtacccgactggctgcgcattttgacgctcaggcgctcaccgaactgacggcattgatcggcctgcaaaatctgtcagcccgttttaattctgccatggacattcccgctcaggggctgtgccgtattcctgaaaaacgttcttaaggagagatgatgcgccattgtgggtggttgctgggattgttatcgctgttttctctggcaacacatgccagtgactggcaagaaattaaaaatgaggccaaagggcaaaccgtctggtttaacgcctggggcggcgataccgcaattaaccgctatctcgactgggtgagcggcgagatgaaaacccattacgctataaacctgaagattgtccgtctggcggatgccgcagacgcggtgaagcgcattcagaccgaagccgcagccggacgtaaaacgggcggctcggtggatctgctctgggtgaacggcgaaaacttccgcaccttaaaagaggccaatttattacaaacgggctgggcggagactctgcccaactggcgctatgtcgacacacagctgccggtgcgggaagatttttctgtgccgacacaaggtgcggaatcgccctggggcggcgcacaactgacgtttatcgcccgccgcgatgttacgccacagccaccacaaacgccgcaagccttactggagtttgctaaagccaatcccggcacggttacctatccgcgcccaccggactttaccggcacggcgtttcttgaacagttgctgattatgctgacgcccgatcccgccgcattaaaagaagcgccggacgatgcgactttcgcccgtgtcactgctcccttgtggcaatatcttgatgtgctgcatccgtatttgtggcgcgaaggaaaggatttcccgccttcacccgcgcggatggatgctctgctgaaagccggcacattgcgcctgtcgctgacctttaaccccgcgcatgcgcagcaaaaaatcgccagcggcgatttgcctgcaagcagttacagttttggctttcgcgaggggatgattggcaacgtgcatttcgtcaccattcctgccaacgcgaatgccagtgctgcggcgaaggtagttgccaatttcctgctctcacccgatgcgcaactgcgtaaagcagatcccgctgtctggggcgatccttctgttctcgatccgcaaaaactgcctgacgggcagcgcgaatcattgcaatcaagaatgccgcaggatctgccgccggtactggctgaaccgcacgcaggttgggtaaatgcgctggaacaagaatggctacaccgttacggtacgcattaatctttttgctgtgggcgatggtggcggtgatttatgcaccgctgatcccggcagctctcacgctgatatcgcctgctttgtcgttgacacactggcaggcgttatttgccgatccacagttaccgcaggcattactggcaacgctggtgtcgacaaccatcgcggcggtcggggcattgttgattgccctgctggtgattgtggcgctgtggcctgggccgaaatggcagcgtatgtgcgcccgtctgccgtggctgctcgccattccccatgtggcttttgccaccagcgcccttctgctctttgctgacggagggctgctttatgactatttcccgtatttcactccgccaatggaccgatttggcatcggtctgggcctcacccttgcagtgaaagaaagcgcatttctgctgtggatcttagcagcagtattgagcgaaaaatggctgttgcagcaggtcattgtgctggattcgctgggctacagccgctggcaatgcctgaactggctgctgttgccctccgtcgcgcctgcgctggcaatggcgatgctggcgattgttgcctggtcgctgtcggtcgtggatgtggcaattattctcgggccaggtaatcccccgacgctggcggtaattagctggcagtggttaacccagggcgacattgaccaacaaacaaaaggcgcgcttgccagcctgctgttgatgctgttactcgccgcctacgttttgctgagctatctgctatggcgcagctggcggcgcactattccccgcgtagatggcgttcgcaagcctgccacgcctttattgccgggcaatacgctggcgatttttttacccttaaccggtgtgctgtgtgtggttctgctggcgatcctcgcggatcagtcgacgatcaatagtgaagcgctcatcaacagcctgacaatggggctggtggcgacattcatcgctttgctcctgttactgctgtggctggaatgggggccacagcgtcgccagttgtggctatggttgcccattttattacctgctctgccactggtggcgggccagtacacgctggcgctatggctgaaactggatggaagctggacggcggtggtctgggggcatctgctgtgggtgatgccgtggatgctgtttatcctgcaacccgcctggcagcgcattgattcacggttaattttgattgcgcaaacactgggctggtcgcgggccaaaatcttcttttacgtgaaatgcccactcatgttgcgccctgtgctgattgccttcgcggtgggatttgcagtcggtattgcgcagtatatgccaacgctgtggctgggcgcggggcgttttccgacgctcaccactgaggcggtggcattaagcagcggcggcagcaacggtattctcgccgcccaggctttatggcaactgctattaccgcttattatttttgccctgaccgcgttagtcgcaaaatgggtaggttatgtcagacaaggactccgctaatgctctgcgtgaaaaatgtttcgctacgtttaccagaaagccgcttgctgacaaacgttaactttacggtggataaaggtgacattgtcacgttaatggggccgtctggctgtggaaaatccactctgttttcatggatgattggtgcactggccgaacagttttcttgtacaggtgagctatggctcaatgagcaacggattgacatcctacccaccgcacagcgtcagattggcattctttttcaggatgcactgttatttgaccagttcagtgtcgggcaaaatttactgctggcgctaccggcgacacttaaagggaatgcccgacgtaatgccgtgaatgatgcacttgagcgttcaggccttgagggagctttccatcaggatcctgccactttgtctggcggtcagcgagcgcgcgttgctctactacgcgcccttctcgcccaaccaaaagcgttactcctggatgagccattcagccgtcttgatgtggctctgcgcgataattttcgccagtgggtgttcagcgaagttcgcgccctggcgatccccgtcgttcaggtaacgcacgatctccaggatgttcctgctgatagttctgttctggatatggcgcagtggtcagaaaattacaacaaactgcgataacgcaaagtttttctcaatgcgtcagttcagaatggcgcactcaaaactacaatgtcgggattttcgatgaaacgtgtttctcaaatgaccgcgctggcaatggctttagggctggcttgcgcttcttcgtgggccgctgaactggcgaagcctcttacacttgaccagcttcaacaacaaaatggcaaagcgatagatactcgccccagcgcgttttataacggctggccacaaaccttaaatggcccttctggtcatgaacttgccgccttaaacctctctgccagctggcttgacaaaatgagcaccgaacagctcaacgcgtggatcaagcaacataacctgaaaaccgatgctccggtggcgctgtacggtaatgacaaagatgtcgacgccgtcaaaacgcgactgcaaaaagcaggtttaacgcatatctccatcctgagtgacgcgctaagcgaaccttcccgtctgcaaaaactgccgcattttgagcagctggtttatccgcaatggctgcacgacctgcaacaaggtaaagaggttacggcgaaacctgccggtgactggaaagtcattgaagcggcctggggcgctcctaagctttaccttatcagccatattcccggcgctgactacatcgataccaacgaagtggaaagtgaaccgctgtggaacaaagtttctgatgaacaactaaaagcgatgctggcaaaacacggcattcgccatgacaccacggtcattctgtatgggcgtgacgtatacgctgcagcgcgtgtggcgcagattatgctttatgctggcgtgaaagatgtgcgcctgctggatggcggctggcaaacctggtccgacgcgggactgcctgttgagcgcggaacgccaccgaaagtgaaagcggaaccggatttcggcgtgaagatcccggcacaaccgcagttgatgctcgatatggaacaggcccgtggactgctgcatcgccaggatgcatcgctggtgagcattcgttcgtggccagaatttatcggtacgaccagcggttacagctatattaaaccaaaaggtgaaatagccggcgcacgttggggacacgctggtagcgactcgacgcatatggaagattttcataacccggatggcaccatgcgcagcgccgatgatattaccgctatgtggaaagcgtggaatatcaaaccagagcagcaagtttcattctactgcggcaccggctggcgcgcgtccgaaacctttatgtacgcacgcgccatgggttggaagaatgtttccgtgtatgacggcggctggtacgaatggagcagcgatccaaaaaatccggtagcaaccggtgaacgcggcccggacagtagcaaataacattgcaattactgacgctggagcgacttcagcgtcagatacccactccacacccgcgtaaaggtcgtcatccagcacaacgcaccgaagatccacgcaaaccacgcaaaccatgcagggaataaacatcccagcacaaacagtaagatcgtttctgtgccttcggttaatccccccagatagtaaaacgacttatgtgcataaccggggttatcaatctgatgttttgctgccagtgcagcaaaggcgagaaaactgctgcccgtgccgataaacgcaaacaacaaccagccgcctgccagcgcattttgctccggtgcagcaagaataaagccaaacggcaccagcgcgtaaaagagaaaatcgagagaaatatcaagaaagccgcccgcgtcggtaagctctctgcgccgcgccagcgcaccgtccagaccatcaagcagcctgttcaacaaaatgacgactagcgccgccagataccagcccagcgccagaaacggcagagccagcacgccgatggcaaatcccactaatgttaaaccatctggcgtaatgcccggtttatcaagaacccgcacgcactgatgcaacaacggtttaatccggggatgaagatggcggtctagcacaggcactccttaaatataaagcctttctgattgagcaacagtgcggatattatggcatttttcgcttatctgcccgtgtgtaatttatgaaaatgattgaagttgttgccgccatcattgaacgtgatggcaaaattttactcgcgcaacgccccgcccagagcgatcaggcgggattatgggagtttgccggtggtaaagtcgagccggatgaaagtcagcggcaggcgctggtgcgtgagttacgcgaagaactgggcatcgaagcaactgtgggtgaatatgttgccagccatcagcgagaagtttcggggcggattatccatcttcatgcctggcacgtacccgacttccacgggacgttacaggcacatgaacatcaggcgctggtctggtgctcacctgaagaggcgctgcaatatccgctggcccctgctgacattccattattagaggcgtttatggctttacgcgccgccagaccagcggattagtgctaagggttttgtcatcacgctggcattgcagcagtattccttcggctttaattaccgccccttcagaataattttgatcctgataaacgcagcactgagtacagggctgcgctgactgcccgcctgaactgaacacttctggcggtacgtttacctccacgtccggacgataatgcgggttagccagtgcaattaatggaaatgctaatactacggcgaacaatgctcgactcacagggaactccttaacgttattgtctctgctactgataacggtagccgggtggcaaaactttagcgtctgagttatcgcatttggttatgagattactctcgttattaatttgctttcctgggtcatttttttcttgcttaccgtcacattcttgatggtatagtcgaaaactgcaaaagcacatgacataaacaacataagcacaatcgtattaatatataagggttttatatctatggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaagttgtaaatgcctgatggcgctacgcttatcaggcctacaaatgggcacaattcattgcagttacgctctaatgtaggccgggcaagcgcagcgcccccggcaaaatttcaggcgtttatgagtatttaacggatgatgctccccacggaacatttcttatgggccaacggcatttcttactgtagtgctcccaaaactgcttgtcgtaacgataacacgcttcaagttcagcatccgttaactttctgcgatagcagcagatatgccagtaaagaaatcccatttgactatttttttgataatcttcttcgctttcgaacaactcgtgcgcctttcgagaagcaagcattatataatgccaggccagttcttcttcaattgtcccgttttgaaaagctgtgcttgatatcgagatcatccatgataattccgccgcccatattagcttcgccgaggatttaccggagctatgattagcgcaatcagagatatagtctgagggaaaaacagcaaatttattcaacaaggcgataacctgctctggggcttcctccatgtttgctttaaaggtattggctccatggtcgccagaaagaaaatgctccattaaggcacaataactttcgctatcttcgataccccattgatcctctaaagactcgcgtcttttacttatgatatcgatcgagtcaaaaggaagcacatgatattggaaggtatctttgccaggttcaggctttcgcggccagaactccagcgtttcagaccattgcttatgatagaatcgataaggtgcgatcaattgtagcgcctgtaacttctcgatactgagcggctcaatacctttagcctgataataatgcagttgttctttttttgctttaaaaccggcccgaacaataagccccatcataattaatagataaagaaaagagcatcccgcggtaatcaggcctctttcattcaaaccgttggatgttatcgctgcgaacacaaacattacagcgacaacacatgttaaataaaacccccacttacaaagcagcatggccttattttctttaatcatccgttcaaaattactattaaatatttcccagccattaaaagaatacttctcgctcccaggatggttttgtaataaaacttttttcatcacattccctgttattacatactttagaggcgataattttatccatgcaaaaaaaatatccaacgaattttcttgatccgctggatatttcagaatatgactcgaatagcacgaaagattcactcgcttacgctatcgccccgcttccgacttcatctgctggcggactttttttcgcactacgtttacgcggtgcagcctttttcttatcagcactgccaccactgcccggagccacaatgccgcgaaactgccgcaccggcgtacgtttggcttgatcaataagctgatatagcgtccccaccagcggctgcataaagtcctgatagcgacactgcttttcgctgatttgcgtcagcaccgattcccagtgcgcggtcatgtccggtcgcgtcgccatctccggcagcgaatggaatagcgcttttccggcgtcggtggagtggatatagcgcccttttttggtcaggaaaccacgcttgaacaacagttcaataatcccggcacgcgttgcctctgtccccagaccatcggtcgcacggaggatctttttcagatctttatcctgcacaaagcgcgcgatcccggtcatcgccgaaagcagtgttgcatcggtaaaatggcgcggcggctgggtttgccgctctaccacttcacctttttcacacagcaactcatcgcctttcgccaccacaggcagtggcgtgccgtcgttttcttcatcgcgctctttgctgcctaacagcgtgcgccagcctgcttcagcaagaaaacgcgctttagcgacaaatttgcctttggcaatgtccagttcgataacacacttgcggaacaccgcatccgggcagaattgcatcagatactgacgggcaatcaggttatagaccttcgcttcgttctccgtcaggttgatcgcagaactccgtgcggtcggaatgatggcgtggtgcgcatcgacctttttgtcatcccaacagcggttgcgtatatctggatctaccactggctgcggcaacagatccggtgcatgaacactgatggcattcatcaccgcgtggcgtccggcaaaatgttcttctggcaaatagcgacaatcagaacgcggataagtgattagcttgtgcgtttcgtacagtttctggcagatatcaagcacgttctgcgcactcagaccaaaacgttttgccgcttcaatctgcaacgctgaaagcgaaaaaggcagcggcgcggattctgattcccgtttatcgttatagctggtgacaatagccggttgaccactaatgcggttaaccacatgctccgccagtggacgatgtaacaagcgcccttcttcatcctggtacggttcacacgcttcgctcggttgccagatagcggtaaaccgctcatcggcaggtgtcacgatatgtgctttgacttcaaagaagtctttcgccacgaagttttcaatctcttcatcgcggcgcaccaccagcccaagcacgggcgtctgcacgcgtcccacggaaagtacgccctgataaccggcattgcgaccgagaatggtatacgcacgggtcatattgatgccgtacagccagtcggcacgcgctcgcgccagcgcagaaacgcacagcggtacaaactcactgttggaacgaagacggtcgatcgcccgctcaaccgcctgcgggttcaggtcgtttatcaagcaacgctgtacctgctggcgcttttccggtgccagttgcagatagtccagcacttcatccaccagcaattgcccttcacgatccgggtccccggcgtgaacgatttcgctggcttcatgcaggaaccgtttgatgacgttaagttgtttggtcacggagggtcggggctgtaattgccacttttccgggacaatcggcaaatccgcaagattccagcgcgcatagcggctgtcgtaggcgtctggctgcgcctgctcaagcaggtgaccgatacaccaggtcaccacctgaccattaccgcactcgataaagccatcgcctttccggtgcggtttgggcaggacatcagcaatggcgcgcgccagactcggtttttcggcaataaacaaccgcattgaattaacgaatctcaaccatggcacgaccgccgcgcgctggcaccagttcgccaattgccgtcagttcaatgccaaactcggcggctgtagctttgacctcattttctgcttccggcatgaccgccagcagcaaaccgccagaagtttgcggatcacacagcagatcgcgcacttcacgcggcatttcacccatcagatgaccgtagctggcaaagttacgttcagtgccgccaggtactgcgcccaacttaatgtactcttcaacaccggggagtttcgggatcgcttcatagtcgacgcgtgcctgcacaccagccccctgacacatttcgctcaagtggcccagcagaccaaagcccgtaacgtcggtcatcgcttttacgccttcgatgttggcaaaggacgcgcctgcgatgttcatccggcacatcacttccgtcgccagtccctgatgttctggtttcaacagtgattttttctcagccgtggtaagaacgccgatccccagcggtttcgtcaggaacagtttgcatccggcttgtgcggtactgtttttcttcacccgctcggtcggtacgatccccgttaccgccagaccaaaaatcggctccggcgcatcgatggagtgaccgccagccagcgcaatacccgcctgacgacatgcatagcgtccaccttcggtcacttcgcgggcaatttctggggaaagtttgttaatcggccagccgaggatcgcaatcgccataatcggtttgccccccatcgcgaagatatcgctgatggcgttagtcgccgcaatgcggccaaaatcgaaaggattatcaacgatcggcataaagaagtcggtggtactgataacgctggtgccattgcccagatcgtacaccgccgcatcgtcgcgggtttcattacccacaagcaaattcggatcaacaaacttcgcctgctcactatgcaggatggtttccaacacttttggggaaattttacagccgcaaccagctccgtggctgtattgggtcaaacgaatcgagttctcgctcatggacatctcctgtcaatgcaatccgggtatggtaaccctcattccgtgaagtgataagtgagagtgtctgaattcctgcgcctttgctcacaatccagacagtttcgcgacaattatcagaaataagttacaaacggcgtcgggtccgggacgttaatcgacgtagatgctttcagctgcggcgtaccgaggtagagaaaaccgacaattttatcctgctcacggcaaccgaatgcttcacgcactaccggactttcagttaatgcgccactgcgccagatgccgccaaacccctgggcaactgctgccatttgcatcgccatgaccgcgcatccggcagacatttcctgttcccagcgcgggactttatgattctcttcgcatttcgccaccaccgtgatgatgagcggtgcgcggaacggcgcattacgggctttgtcgatagctttgtcatcactaccggcagcaatcgccccctgttccagtacggcgctgaaacgctcgcgcccttccccttcaatcacaaaaaaatgccacggttgcatggacttatggtccggcgcacgcatacccgcacgcaggatgttttgcagttgttcacccgttggcgcgggttcagccaagcgggaggcgctacggcgattgatcaatagttcgagtgcatccatttgattaactcctgtcgtgatatttattcacaaaattaacacgagagtggattttgttacagcacagtccgcaattcctgctgacaagtaccggttgggtcattacgataaccacatctattgcgcctgtgacaggtgtgaccttaagttgggagaatacatgcgaaccctttggcgatttattgccggattttttaaatggacgtggcgtctgctgaatttcgtccgtgaaatggtacttaacctgttctttattttcctcgtactggttggtgtggggatttggatgcaggtcagtggtggtgattcgaaagaaacggccagtcgtggcgcactgctgctggacatttctggtgtgatcgtcgataaacccgacagttctcagcggtttagtaaattaagccgccagctgcttggtgccagttccgatcgtctgcaggaaaactcactgtttgatatcgtcaacactattcgccaggcgaaggacgaccgcaatatcaccggtattgtgatggatctgaaaaacttcgcaggcggcgaccaaccgtctatgcagtacatcggcaaagctctgaaagagtttcgtgacagcgggaaaccggtttatgccgttggcgagaactacagccaggggcaatattatctcgccagtttcgccaataaaatttggctgtctccgcaaggcgtggttgatctgcacggctttgccaccaacggtctgtactacaaatcgttgctggataagctgaaagtttccacccatgtgttccgcgtgggtacgtataaatctgccgttgaaccgtttattcgtgatgatatgtcaccggcagcccgcgaagctgacagccgctggattggtgagctgtggcaaaactatctgaatactgttgccgctaaccggcagatccctgctgagcaggtattccctggcgcgcaagggttgcttgagggtttaaccaaaaccggtggcgataccgcgaaatatgcactggaaaacaagctggtcgatgcactggcatcgagtgcggaaatcgaaaaagcactgaccaaagaattcggctggagtaagactgataaaaattatcgcgccatcagttattacgattacgcattgaaaacgccggcagataccggtgacagcatcggtgtcgtctttgctaatggcgcaattatggatggcgaggaaactcaggggaatgttggcggtgataccactgcggcacaaatccgcgacgctcgccttgacccgaaagtgaaagcgattgtcctgcgtgttaatagcccaggcggcagcgttaccgcgtctgaagtgattcgcgctgaactggcagcagcccgggcagcgggtaagcctgtggttgtatcgatgggcggcatggcggcatctggtggttactggatttccacgccagctaattacattgtggctaaccccagcaccctgaccggttctatcggtatcttcggcgtgatcaccaccgtagaaaatagtctggattcgattggtgttcatactgatggtgtctcaacttcaccgctggcggatgtttctatcaccagggcactgccgccggaagcgcagctgatgatgcagttaagcattgagaatggctataaacgctttatcacgctggttgctgatgcgcgtcattcgacgccggagcagattgataaaattgcccagggccacgtctggaccggtcaggatgcaaaagctaacgggctggtcgatagtctcggggatttcgatgatgcggtcgccaaagcagcagagctggcaaaagtgaaacagtggcatctggaatattacgttgatgaaccgaccttcttcgacaaagtgatggacaacatgtctggttctgtccgggcaatgttgccagatgcgttccaggccatgttacctgcaccgctggcctcggtagcctctaccgttaaaagtgaaagtgacaagctggccgcgtttaatgacccacaaaaccgttatgcgttttgcctgacctgcgccaacatgcgttaagtcttgtactgagtggccgacagatcgtcggccacattattttttacgtcgacgaatcctcttcccgctgtttcgccccatatttccttatccgcatagtatcaggtgcgctccccctgcctcacgtatatacttttgctctttcgatatcattcatatcaatatcatgcaaaagaaatcaatttacgttgcctacacgggcgggaccatcgggatgcagcgttccgagcagggttatataccggtgtcaggtcatctacaacgccaactggcgctgatgccggaattccatcgcccggagatgccagatttcaccattcatgaatatacgccgctgatggattcttcagatatgacgccggaagactggcagcatattgctgaagatattaaagcgcactatgacgactatgatggttttgtcattctgcacggcaccgacacgatggcgtataccgcctctgcgctgtcgttcatgctcgagaatctcggtaaaccggtcattgtgacagggtcacaaatcccgctggctgagttacgctctgacggacaaattaatctgctgaatgcgttgtacgttgcggcgaattatccgatcaacgaagtaacgctctttttcaataaccgattgtatcgcggcaaccgcactaccaaagcccatgccgatggttttgatgcgtttgcctctccaaaccttcctccgttactggaagcaggtatccatattcgtcgtttgaatacgccacccgccccgcacggtgaaggggaattaatcgttcatccaatcaccccacaaccaattggcgtagtgacgatttatccagggatttctgctgacgtcgtgcgcaattttctgcgccaaccggtgaaagcattgattctgcgctcctatggcgtgggtaatgcgccacaaaacaaagccttcctgcaggaattacaagaagccagcgatcgcggtattgtggtggtcaacctgacacaatgtatgtccggtaaagtgaacatgggtggttatgccaccggtaacgccctcgcccatgccggcgtaattggcggtgcagatatgactgtagaagccacgctaaccaaactgcattacctgcttagccaggaactggatactgaaaccattcgcaaggccatgagccaaaacctgcgcggcgaactgacgccggatgattaaggagactgtaatgccccctcgcgccctgttactggtcgatttacaaaatgatttctgtgctggtggcgcgctcgccgtgccggaaggtgacagtacggtggatgtcgctaaccgcctgattgactggtgccagtcgcgcggtgaagcggttatcgccagtcaggactggcacccggcgaatcacggcagttttgccagtcagcacggtgtagagccttatacgccaggccaactcgacggtttgccacaaaccttctggccagatcactgtgtgcagaacagtgaaggcgcacaattacatccgttactgcaccaaaaagcgatcgcagcggtgttccataaaggcgaaaatcctttagttgacagttacagtgccttttttgataacggccgtcggcagaaaacctctctcgatgactggttacgcgatcatgaaatcgatgaattgatcgttatgggcctggctactgactattgcgtgaagtttaccgtgctggacgcgttacagttaggttataaggtaaacgtgattaccgatggttgtcgtggcgtgaatatccagccccaggacagtgcgcacgcgtttatggagatgtcagcagctggggcaacgctatatacgctggcagactgggaagagacacaggggtaattttacgctggcctacaattctgtactggcattgtaggccaaataaaacacgtcagtggcacatctggcaattgatgccatcaacgaaagatttaattcacctcagaaatctcttccaacgacaccttccgcgtttcgatgccaaaaatggagagaaccagcgcacagagcaataacataacaccaagtaccataaacaccgtgatcgacccataatgtgttaataatgccgcaacgccatagggcgtgaagactgcgacgatccgtccgacggcattaacgaaacccgaaccgcgcaggcgtaaatgcgttggccaaagctccgggatataaaccgccgacgcgaagcaaacatacatgtataaaaagaagatcatcaccagtccatagattaaaatcgcccactctgtagtctgaattgaatagatatagcctaacacggcaataataataagtaaggtggagccaaataaccgacgaggaaaatgatcaataattaatgccgcaataaatattcctaccggagcgccaatcataataacagcggtcattaatattgatttatcgacatcaatgccggagttaacaaatatggtcggtatccatacggtgatggtataaagcgaaatgttcattgcaattaaaacagtaatcgcgactaatgtacgtcgtaacatttcacctttaaacaggagccagaaagtacccttgattactttaaccttgctgttgctctgatacgaagtaagcgggggtaaacgaatactcttctctctttcaatttgctgctctacttcacgaagttggcattctgcacctgcgatttgccctttccctgccagccatcgtggcgactcgataaagtatttacctgagagaaaccaggctaacagtatgccaataccacccagcagaaacattattcgccaactaaaaaaagcgataaccaccacgcctatcgccgcagacagcatgggcgaccagttaccaacaaatgagagccgcgcggaccattttccacgcaccgtcgcggggataaactccgtaaatgaggcatagccaaccataatcagcgcccccattcctgttcccatcaggaagcgaaagaagatgagccagtacatatcagggacaaaagcggcccctgttgcagcaataccgacgatgagaagatttatgcgaaacgccctgcgccgcccaaagtagtcaccaataaacccaccagtaagtgagccgatgaaataaccaaacattaatgccgaggtaaaggcggcattgaggaaattatttgaccatccattgcttaccagctttgctaagacgacattaccggagtaactcaaaaaccctgttaataacagactaaagcttataataccaaatatacgataatgaaaccgggccaaaggcaagcggtccagtcttgcgccaatttgatcatattgttccattaggtgcctcggatttgctaaaaaggtagcaattgcggcaaattcacttgccgcatctttatcatcattttatttcaaggcgcaggaacaaataatattgacaacgtgtgcttaaattaccacaccagctggatattattgtctttgcaaaatgctatccactctgcacccggtgatttatcagttattatgtaattaatatgactaaaatcagctaactggacaaaagctttgcgatcaaacttagagtgatcaaccaataacgcaacttctgtcgcctgacggatcattgtctttttgatttcagcttccgcttcattagagtccagcgcgccgctgttaatatcaagacctttacaactcattaccatgatatcgacatgatagcgcctgatgatctctttagtaattcttccttgcagtgaaagtgtatttttgtttagttccccacccgttgaaacgactttaatttctgactgagccagaacatgaatcgcttccgccgagttggttagcaacgtcaggccactacggtcctgtaacaatttgagcaattccattacggtactactggaatcggctgccatggtggttttattgtcgataaagggtagtgccttgcgtgcaataagctgcttctcttcataaaacgatgaagcgcgcttataaaaatggatattctccgtcaacatcgctgtatttaaaacagcaccaccataggttctggtcaaaaagccttcatcttccagcttctcaagatcgcggcgaatggtttcttcggttacctgaaaaatcccactcaaatttgagactgtcacctttttatcgttggcaaccatttgcttaattgcctgaatcctgtcttttgccgccacgattacacccctgtatctttttacatcacattagcgcgattatcgcataaccgatgtttactttcaaaataacctgtttgaatcacagattttcatcacagttttcacagaaacagaggtgaatcgtgttgagtatttaacgctccagggcctctgccatttccctcatcaatgttgcgtctgcatccgataagttgatattcagtgccgcgacattttcgcgtacctgttccggtgcagtagccccactaagaatggagattaaatcactctgttttaatatccacgccagtgccagagtgggaattgtgcactgataacgagcacaaagtggctgccactgttcaagcatatcaatcactttcagcatgttttcacgctggaaccagactttatttgcccgagcgccgcccggaacgtaatcacgagtgatggtgccggtcaacaatccctgctctagcggggaataaacctgaaccacaatgccattatcacgacatagtggcagcagttcgttttccattgcccggtcgaggatactgtatttcgcctgaataatatccagttcaccatattgcagatactcgcggatatggtcagcatcgacgttagcagcgcctatagcgcgaattttcccttcagactttaactcattaagcactgcgacagtttcagcgatcggcgtaaaaaatggcggcaccgactgccagtgcgtcatgtagatatcgatgtaatcaatacccagacgttgcaagctcgctgctacctcttcgcggatagattccggggaaaggtttttatacaactgccgatcgccaactttgttgaataaacttccttttcgttcccagacaatgccgcatttggtttctactacaacctgttcacggggcagtttttttaacgcctgaccgacgataacttcactattgccaaagttatatcctggcgcagtatcaatcagattaatgccacaacgatgggcttcaagaatcgtatcaatacatatttgccgatcgagatcgccattccatgcaggaccgccgccaatggcccatgtccccaaccccattcgcgaaagcgtaatatccgttgtgcctaaaggtatctttttcatttgccttcattatccttcgtattcttccagcaattgttcgaccagctttctgttttttacgccggtggtggcaccgacgcttagaaccgagatagccgccgttgcattggcaaagcgtgcgcattcacgcagatttttgccttctaacagtgccgcaataaaacctgaagcaaagttatcgcccgcgccaatggtgtcgatggcggttattcctgcgaccgccggcaccttcatcgtcatgtcaccacgcttgataaagcagccgtctttacccgttttaatcaccaccgtttttacgccgcacgcaagaaagcagtcagcaatttcatccagtgtctctttcccggtgagtaattttgcctcggcaaaattaggaaacagataatcgacataactcaatgcttcgcaaatatcatccagcgtttcattcaaccgcggtttgatcatatcggcacagataatcatctgccgggctttagcttgcgtaaaaatttctgttagcgctttaccatccaatagtggactgttgaaaatactggccagtgataataatttcgcctgagaaaaccgcgcaaaatcaacatcgtcaatattcaatttccacagactgccattacggtttgtgacaaacgtccgctcgccatcctccgtcaccagtccaacgttaatagaggtatctatgctgacgtcctgcttcaggctttgaatatcaatattctctttgcggcaatggtcgagaataaattgccctgcggcatctttaccaatacgactcattaatgctgtgcgatggcccagacgagaaataattgttgcttcatttattgcatcacccccggtggtcattgcgattctttcaagaggataagaatccacatcaaagatatttttactgaccggttgcaatggaatatcaacaatagcggcacctatacaaataacgtcgagattatccatatcattattccgctttgccatcagaaccgaacagtttaattttttccaatgcccgttcttttacagctttacgtacttcacgttctaaatgcaggaaaggctgatcctggttttctttcactgcaaccattgcggcctgacagagctccgtatgaatgttgattttcgcgatacccaacgaaattgcagttttaatgtcggcatcactgatccccgatgcaccgtgcaaaaccagcggaacagaaacggcatcgcgtacgcgtttgacgacctcaaagttcaattgtggctctgacgtataaaccccatgctggttgccgatggcgacagccaatgaatcacagcccgtacgttcaacaaattcagccgcctggtcaggatcggtatagtgatagcccgccagcgcttcctcataaacggtttcattaccgacatgccctaattccgcctctaccggaatacccagcggatggaagaaatcgacagcctctttggttaaacgaatattttcttcgaaatcaaacgcggaagcatcacgcattaatgaattcataccatgagtccaggcgttatgaataatctccatactccgaccatgatcccaatgagttattaccggcaccgttgctttttgtgccattgataccatcatgtgagagaaatcttcaaatgaggtgttaccgacaaaacctgtaccaaaagaaataataaccggggatttcgcttcttcggctgcgtcgataacgcccatcaacatttctgcattccatacgttaaaatgggcaattgcataatgtttatttgtggcatcgttttcccaatatctgatatctgcgagcatgttctgttctcccgtattaattaatcgctaattttaataacgcctttaataatgtcgcgtttgttgttaactgactcttcaaatgcctgttgtacatcccgataatcgtaaatatgcgtcaccatcgatttcacatcgaatcgccctgaagaaatagcttcaatcgtgaccggataacgattggcatagcggaataccgtctggatagtgacttcgcgattgattttgaggaaattgattgccgaatcgccgggtacagtaccaacaatcataattttaccgccgcgcattaccagataaggtgcctgtttaacggtgaccgcagaacccgctgtttcgaaaacaatatctgcgcccatgtcttcggtaaattgctgacagcgtgcaatagtgtcttcttttgcgccgttaataaccactgtcgcaccaagctgttccgccattgccagacgtttttccagcacatcaacgacggcaatttccgttgctcccaggcatttgcacgcttgcaacgtcatcaaaccaatacaacctgctcccagaataattatcttcttacccggtttaacatctgccagcatcgcggcatgcatcccgactgcggcaggctccaccagcgccccttccatcgtgtccatattgtcgggcagtttgtaagtaaagctctccggatgacacagatagtgcgttaatgcgccgcggtagttgggttgtgtcgccataaaatcaacgtccgggcagatgttatatttgccttccagacagtaacgacagtgaccgcaaggaacgccaggttcgatatttacccgatcccccggtttaaatttgcgcacgcggcttcccacagccacaaccgtcccggcgcattcatgacccaggccaatttcttgatttgggtctttaggcggaataaacgggcctgattcaaaaccatgtacatctgaaccacaaataccgacatattctactttaatcaaaacttcatcttctttaggcactggtatttctgctgaaataattttcattgtgcccggcacctgcaatattgcttttgaatttttcattttgaatccacccgtattatttattggctactgcatcaatacttaaactttcaacggagacacctttggtttcgattccaatggtggcgatagcaattgcgacaataattgaaaccgcccccagaagaataaagactcccgtaacgccataactactgagcagcactgcaacggcataaggtgcggcaataccactgattcgccctaccgcattcgccagaccggagccacggagtttggcctctgtcggccagatttcagggacatacactgccgaggcatagcaaacgtacatatagacgaaagtaatcaggaagaaaccaatcaacgttatgagcaacatactggtttgcagtgaatagatatatccgagcaccgcaatcaggattaatagccccacacccattgttttacgcggaattttatccatcaccagcatggcaataaaaataccaaatggcgcgccaaacatactcatggtatttaaaacaatcgagtcttttaaattaatcccctgggtcatgaatattgttggcaaccagttaattagtgtgtactgcacaacgttcatggcaatcagcacacaagagcctaatatcacgcgtttcagtaatactcctgtcagtaaggctgaatacggcaccgcttgtggcgctttaccgtcatcagcaataaccacaggcggcaaaggtttacccgtctggcgtatgacgccttcttctatactccgcatgactttctcggcttcctgataccgtccgcgcgattccagccagcgcggggattcaggaaagtagcgccaggccagcgccgtagcgataagcgacaatattgcagggataagcagttgtacccgccagttccactctgcactaatcagcggcgtgagtcccatcgctatcaatgaacagagcggatatgaccagttgccaataaaggaaacccgacttgaccacgttccacgatttctaccgggcatatattcggtgaaaccagcaaacagcgtaaccagtaaagctcccagcccaactcccatcacaaaacggcaggcaataaggaaatccatattcggtgagaaagcaccgacaaccatcgaggcaatatgaatggcctcatagaggatgaacgcatttctgcgaccggttttgtcgccaatgatgccgcccaccagcgcaccgagaaacattccggcggtcgtgattgctgagaatgtggctgtggtggaattatctgtccagcccaacgctttcagctgcgcgaggatcaagccaccaacggcattactccagcagacaagcaagccaaacgcgacgatggcaaacattgatgaatgccagcggcaatccggtaagcgatccagccgtgcaccacaatgcggttttgttatctgttccatgcgataacgttccttcaggagagtggttattcatcaaagtcgtaagtcatgatcactttgattgcggttttatcgaccatcgcatcaaacccttcgcgccattgcgacaggccgatacgatgcgtgatcatcggtttgactttgatagcgccgctggctaatagcctgatagcgttacgccatgaggtggagtcataggccatatgcccaatgatgcttttgttccaggcggtaatgtcattaatcgagaaatcaagaggtttgaagcccattccaacgcgtaccacttccccgttcgggcggagcatttcgatggcttgtttcagtgcgatattggcaccggagcattcaatcaccagtcccagattgtctttgccacaaatttgctggcagcgcgccaccacatcttcggtagaaccatttactactgccgtcgcacccagttcttttgcaaccgggaagcggaccgccacatcttcttgcagaccaacgacgacgatatttaccgcccccataattcgcgccatttgtacggagaacagcccgagtgggccagtgccgatgacgaccacatcctgaccaggaaggaatttcgattgctgcgcgatggatttgtaggcattacagatagggtcaagtacggctgcgtcctcataatcaacaccatcagggatttcccacaacgcatgacgatgaattttgagaatttcaccaggaaccagacaatatttggaaaaaccaccgccccaggtattattatccagaccaaggtttactttttctgtacaacacagaaaatcaccttgttcacaggccggacaaacaccgcaaacgtgaccgctgttatccgatacgacgcgttgccccactttccagtctttgactttttcaccaacctgcgcaatacaacctgcgaactcatggccgcggatagagttaaactcatcagaaccgctatcgacattgtagtgcttcatgtctgcgccgcagattgccgcggctttaatttcaatcactacatcttccgggccacacatgggttgtgggacatcaatcatcttgtagccgccaaaggccttgccaaaccgagccagtgctttcattgcgtcatcctctgtgtttagttttgcttagatggccatcatacttacccacatgatttttgaggtcaacattaaatctgtaaaacacagataatgatctgcgttttacaactcagatcacaattacgcagaaaatggctgggtctgttacaggttgatggaaggcggggcgcaaaaagagcaaattcgagagggattaccggccaaataggtctgagacttaagttcaggagaagtcattcaggtgtgaacgggacggcaagagatcggactgggacttagccaggtcatggcgagataattgagatgagtcgtggggtcattgttggctatccccttcatagccgaggcaaaaaggggatgaaccacttacttaaacatggcaataggctttgctgagataccaaaatcttcttttaactgctgtttgctcttcatgaccatctgaccatttgtgtcaattgtcatatgctgtgcttcgatattatggcgggcttgccacagcatcaccagttgcaggcagttctctttttgttcctcggtcaacgcaacgccatcaggccatttccccagttcaacggcggtcgacaaacgctggtatacctcaggcatcatgctgttgataatgtcatcaagattcataatttttccgctcctgtggaataagttgctgaatcgttttttcaaccgttgatttcttcgccgttttcgccatcggtaaagcgtaaagaggcagagttaacacaataacgttcgcccgttggctgcggcccgtcggggaagacatgccccagatgggcatcacagttaccgcaacgaatttctatgcgctgcattccatgtgacaagtctttgatataacgaatggattcttcacttaccggttcgtagaaactgggccagccacagccggaatcatacttggtttgggaatgaaacagcggggcatcgcagatcaaacagtgatatacgccgtcacgcttgttatgcagtaaacgacccgtaaatggcggctctgtcccatgattctgcgtcacgtaaaactgcatctcggacaaattttttttcagttcttctgccgaaggtttattagccatttgctcacatctcactttaatcgtgctcacattacgtgactgattctaacaaaacattaacaccaactggcaaaattttgtcctaaacttgatctcgacgaaatggctgcacctaaatcgtgatgaaaatcacatttttatcgtaattgccctttaaaattcggggcgccgaccccatgtggtctcaagcccaaaggaagagtgaggcgagtcagtcgcgtaatgcttaggcacaggattgatttgtcgcaatgattgacacgattccgcttgacgctgcgtaaggtttttgtaattttacaggcaaccttttattcactaacaaatagctggtggaatatatgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataagttgagatgacactgtgatctaaaaagagcgacttcggtcgctcttttttttacctgataaaatgaagttaaaggactgcgtcatgattaagaaaatttttgcccttccggtcatcgaacaaatctcccctgtcctctcccgtcgtaaactggatgaactggacctcattgtggtcgatcatccccaggtaaaagcctcttttgcattacagggcgcacaccttctctcgtggaaacctgcgggtgaagaagaagttctgtggttgagcaacaacacaccgttcaaaaatggcgtcgctattcgcggtggcgtaccggtttgctggccgtggtttggtccggcggcacaacaaggtctgcctgcgcacggttttgcccgcaacctgccgtggacgctgaaatcacatcatgaagatgctgatggcgtagcgctgacttttgaattgacgcaaagcgaagagacgaaaaaattctggccgcacgactttacgctgttagcgcatttccgcgtgggtaaaacttgtgaaatcgatcttgaatcacatggcgaatttgaaaccacctctgccctgcatacctactttaacgtgggtgatatcgctaaggtaagcgtcagtgggctgggcgatcgcttcattgataaagtgaatgacgcgaaagaaaatgtactgaccgatggtattcagaccttccctgaccgtaccgatcgcgtgtatctgaatccacaagattgcagcgtgattaatgatgaagcgctgaatcgtattatcgccgtaggccaccagcatcatctgaacgttgtcggctggaacccgggaccggcgctttcaattagcatgggcgatatgccggatgatggctacaaaacatttgtttgtgtagaaacggcttacgcttcagaaacgcaaaaagtgaccaaagagaaacctgcacatctggcgcaatccattcgcgttgcgaaacgttaatttacgttaatgttgtgtgccgggtgcaatgcatccggcacacaacatcacaccatatccagcgcagtttttccttttggtgccggatatgccttatccagcatagctaattccgctgaagaaagttcgacctcaagcacagccgcattttgttggacatgggcaatcgtggccgcttttggaatcgccatcacaccctgatgactgatcacccacgccaacaatacttgtgccgcgctgatattgtgagcatgtgcaatttcgttgactaccgcgttttttaacagtccattgcgcaaccgcccggcctgggctaacggactgtaagccatcaccggcatctgctgttgctggcaccaggggagtagatcgtactcaattcctcgtgaaccgagatggtaaagcacctgattagtggcacactgatttccccccggcagctgccagagttcctgcatatcagcataatcaaggttagaaacgccccagcggcggatttttccctgggcgatcaatttttccatcgctgcgacagtctcttcaaaagcgaaactgccagaccagtgtaataagtaaagatcgagataatcagtattgagacggcgtaaactggcttcgcatgcatttatcgctttttgcccgccagcattccacggatagactttagagacgagaaagaccttctctcgcagaccggttaatgcttccccaaccaccttttcggcaccgccatcggcatacatttcggcggtatcaatgagggttaaaccgagttcaatgcccgcgcgtagtgcagcaacttctgttttgcgctgactggcatcttcgcccatataccatgttccctgccctacggctggcagtgagacatcgccactaaattgaatcattttttgttgcattgtttcctcccaggtattgcaccaccgtaatgcaaaacagggcgtgacgccctgtttttatgcacaaaatgccctggaaagatgcattatcagaatttgtaggtgatcccggtagaaatcaggccagtccaggatttatccaccatcgggctgtcagtaacttcatcagacagacgggtgtagcgtgcggtaccgtaaacactccagtcgccgaggaagttgtagctggcgctcagctccaggtaagggctccagctgtcgttcgggttatagccacgcagaccgctgcgagcggactctttgcgcgatacgccataatagtattcgttctggttttcgctgttccactgcacaccaatacccggagtcacggtcaggccaccgttggtgtaacgatacaaccaggccatatcccagacgatgccgttgctgttatccagggtatcgccagccagggtggtacgcaggtaaccgtactgggtaaagtgagcataagacagaccagccatcatggtgctcttacggtcatccaggtgacgcatttggtgatcgccactgtctttcgctttgaagtaaagcggcgaccagtaagcggtaattgaaagtttatccgttgcgtcattccacaggtagtaaccaccacctaagccacggaaccagaagttatcgccttcatagttgattaccggtactgggtaaacatcggtatcgtaatctttatatgggtgttcaacgacacctacgcctgcgcccagggaaaatttaccttcagcgtgcgctacgcctgcagacgttgcgataagcactccaagtgccagaagtttgagtttggtcacaattaatcattccttaaacaaatgtttagcgggcgacaaagtttacccgtcaatacatcgaaacccaacctttttacgttttcattttttaaagtaactgtttaattttcctgacgcggatgacaccgcgcttacagccaaatgaatttagcgttactggcgagcctggtctttacattaattatgcaaaatttatggatgagttgttgatatgccattgaaattaagaaagccgtgcaggcaagttttccatttgccatctacgcttaattttgaaggtgtatcaccgggcacgttgttctcatcgtcgataaaatggcatgagagttgctgtgttttagcaagagacgtcgttcagtttacctcttccgggagcctctactattcatatgaacggctcttaacctgtgctaaaaaacgaaaggacggcataccatgaatatattcgatcactatcgccagcgatatgaagctgccaaggacgaagagttcacactgcaggagtttcttaccacttgtcggcaagatcgcagtgcttatgccaacgcggctgagcggctattgatggctatcggtgagcctgtcatggtcgatacagcccaggaacccagactttctcgactcttttctaaccgggtcattgcacgttatccggcgtttgaagagttttacggcatggaagacgcgattgaacagattgtctcttatctgaaacacgcggctcaggggctggaagagaagaaacaaatcctgtatctgctggggcctgtgggtgggggtaaatcatcgcttgctgagcgactgaaatcattaatgcagctcgtaccgatttatgtattgagcgcgaacggtgagcgtagcccggtcaacgatcatccgttctgtcttttcaatccgcaggaagatgcgcagattctggaaaaagagtatggcattcctcgccgttatctcggcaccatcatgtcgccgtgggcggcaaaacgcctgcatgaatttggtggcgatatcactaagttccgggtagtgaaggtctggccgtcaattctgcaacaaattgctatcgccaaaacggaacccggcgatgagaacaaccaggacatctccgcgctggttgggaaagtcgatattcgtaaactcgaacactacgcgcagaatgacccggacgcctacggctattccggtgcgctgtgccgcgccaatcaggggatcatggaattcgttgagatgtttaaagcaccgattaaagtgctgcatcccttgttaaccgccactcaggaaggtaactacaacgggacggaaggtatctccgccctgccgttcaacgggattattctcgcacactcgaacgagtccgaatgggtcactttccgtaataacaaaaacaacgaagccttcctcgatcgtgtttacatcgtgaaggtgccgtattgcttgcgcatttccgaagagatcaaaatctacgagaaattgcttaatcacagtgaattgactcacgccccatgcgcccctggcacgctcgaaacactgtcacgtttttccattctttcgcgcctgaaagagccagaaaactccagcatttattcaaagatgcgggtttatgatggcgaaagtctgaaagacaccgatcccaaagccaagtcgtatcaggaatatcgtgactacgccggtgtcgatgaagggatgaacggtctgtcgacgcgttttgcgtttaagatcctctcccgcgtgttcaacttcgatcatgtagaagtggcagcaaacccggtccatctgttctacgtcctggaacagcagattgagcgcgagcagttcccacaagagcaggcagaacgctatctggagttcctgaaaggttatctgatcccgaaatatgccgagtttatcggcaaagagatccagacggcctaccttgaatcctattccgaatatgggcaaaacattttcgaccgttatgttacctacgcggatttctggattcaggatcaggagtatcgcgatccggataccgggcagctgtttgaccgcgagtctcttaacgccgagctggagaaaatcgagaaaccggcggggatcagtaatccaaaagatttccgcaacgagattgttaacttcgtactgcgcgccagagcgaataacagcggacgcaatccgaactggaccagctatgaaaaactgcgcacggtcatcgagaagaaaatgttctccaataccgaggagctgttgccggttatctcgtttaacgccaaaacgtcaaccgacgagcagaagaaacacgacgactttgtcgaccgtatgatggaaaaaggctacacccgtaaacaggtgcgtttactgtgcgaatggtatttgcgcgtacgtaaatcgtcttaacaaccctggcccggtacacatgttaccgggcctacaacgacagcgaaccgtgggcctgagaagcggcaacacaggcgtagcatacagttggcaaatgtagtacggggggcatatgacctggtttattgaccggcgtctgaacggcaaaaacaaaagcatggtgaatcgccagcgttttttacgccgttataaagcgcaaattaaacagtcgatctccgaggccattaataagcgttcggtgactgacgtcgacagcggcgaatccgtatccattcccacggaagatattagcgaaccgatgtttcatcaggggcgtggcggtctgcgccaccgcgtgcatccgggcaatgaccatttcgtccagaacgaccgaattgaacgtccccagggtggcggcggaggttccggcagtggtcagggccaggccagccaggatggtgaaggtcaggatgaatttgtctttcagatttcgaaagatgagtatcttgatctgctctttgaagatttggccttaccgaatctgaaacaaaaccaacaacgccagctgaccgaatataaaacgcatcgggcgggttataccgctaacggcgttccggccaatatcagcgttgtgcgttcattgcagaactcactggcgcgacgcacagccatgacggcaggcaagcggcgggaacttcatgcactggaagagaatttggccatcatcagcaacagtgaacctgcgcaactgctggaagaggaacgtctgcgcaaagaaattgcagaattacgtgccaaaattgaacgcgtcccttttattgacaccttcgatttacgttacaagaactacgagaagcggcccgatccctccagccaggcagtgatgttttgcctgatggacgtttccggttcaatggatcaatccactaaagatatggctaagcgtttttatattctgctgtatctgttcctcagcagaacgtataagaacgtggaagtcgtatacatccgccatcatacccaggcgaaagaagtcgatgaacatgagtttttctactcgcaggaaacaggcggcaccattgtttccagcgccctgaaactgatggatgaggtagtgaaagagcgttataacccggcacagtggaatatttacgctgcacaagcatcggacggcgataactgggccgatgactctccgctttgccatgaaatcctggcgaaaaaattattacctgttgttcgttattacagctatatcgaaattacccgtcgtgcacatcagacattgtggcgagaatatgagcatctgcaatctactttcgacaactttgcgatgcagcacatccgcgaccaggatgatatttatccggtgttccgtgaactgtttcataaacaaaatgcaacagctaaaggctaaaactatcagccaggtcattatcgcctggctgatttttagcttactgtaaattatctcatttattacatacattagcttacaatcgctttaaatatgacagcataacctttacataatttagttccagaaaacaatcattcggaaaaatgattcagtcaacacgtatttccatggggttattctttaaatattttttatcgttaacgaaaattgatcctggtcaaaactatatatctctgccatcaataaaatccagcactcacattgctctcctttttatggtttctatgggtacacaaaaattaaaagctcaaagcttttttattttcagtttattgctgacgttaattttattttgcattactaccttatataacgaaaacacaaatgtaaaactcatcccacagatgaattacctgatggttgttgtggctttgtttttccttaacgccgtcatttttcttttcatgttaatgaaatatttcactaacaaacaaattttaccaacactcattttaagccttgcatttttaagtggccttatctatttagttgaaaccattgtaattatccataaaccaattaacggcagtacactgatccagacaaagtcgaatgatgtttctattttctatattttccgccaactcagttttatttgtttaacctcgctggcgctcttttgttatggaaaagacaacatccttgacaacaataagaaaaaaacgggaatcctgttgctggcgctgatcccttttttagtttttccccttctggcacacaatctgagcagttataacgctgactattctttgtatgtcgtcgattactgtccggacaaccatactgcgacctggggaatcaactatacaaaaatattggtttgtctgtgggcatttttactgttctttattatcatgcgcacacgattagccagcgaactatggccgttaatagcattattatgtctggcatcgctatgctgcaacttacttctactgactctggatgagtataattatactatctggtatatcagtcgcgggattgaagtttccagtaaactgtttgttgtgtcttttctgatttataacatttttcaggagctgcaactctccagcaaactggcagttcatgatgtgctgaccaatatttataatcggcgctactttttcaacagcgtagagtcattattgtcgcgacctgttgttaaggacttctgtgtcatgctggttgatattaatcagttcaaacgcatcaatgcccaatggggacatcgtgtgggtgataaagtgctggtttcaattgtcgatattatccagcaaagcatccgccccgatgatattttagcgcgactggagggtgaggtgtttggcttgctatttaccgaactcaatagtgcccaggcaaaaatcattgcggaacgtatgcgtaaaaatgtcgaactcctgaccggctttagtaacagatatgatgttcctgaacaaatgaccatcagtattggcacggttttttcaacgggtgacacgcgtaatatctcgcttgtcatgacggaagcagataaagccttacgcgaagcgaaaagcgaggggggcaacaaagtgattattcatcatatttaagtgcaaaaatattcagagccatgctttttgcgtggcttttgcatacaatttattactattacccctaaatttcccctccccagcggcgcagagatgagtataattagcgcccctgtgccaggccgcaatcgaactttatctggttttctcgtttcactaaccgaaggagtgccatttatcatgaaattgcaccatagaatgctccggcattttatcgccgcaagtgtcattgtgctgacatcttccttccttatttttgaacttgtcgccagcgacagagcaatgagtgcctatctgcgctatatcgtgcagaaagcagactcctcctttctttatgataagtatcagaatcagagtattgccgcgcatgtgatgcgcgctctcgctgctgagcagtcggaagtgtcgccagaacagcggcgcgccatctgcgaggcttttgagtctgccaataacacccatggcttaaacctgactgcccataaatacccgggcttacgcggcacactacaaaccgcatccactgactgcgacacaattgtggaagctgcagcactattacccgcttttgatcaggcagtggaaggcaaccgccaccaggatgattacggttcaggtcttgggatggccgaagagaaatttcactattatctcgatctcaatgaccgctatgtctatttttatgagccggttaatgttgaatactttgcgatgaataactggtccttcctgcagtcaggaagtattggcatcgatcgcaaagatattgaaaaggtatttaccgggcgtaccgtattgtcgagcatttaccaggatcagcgtactaaacagaacgtgatgagtttgctgacgccggtatatgtcgcagggcagctaaaagggattgtgctgctggatattaacaaaaacaatctgcggaatatcttttatactcatgaccgccctctcctctggcgttttctcaatgtcacgctaaccgataccgattcggggcgcgacattatcatcaaccagagcgaagataatctgttccagtatgtcagttacgtccatgacttaccgggcggcattcgtgtctcgttatccattgatattctttactttatcacgtcttcgtggaaaagcgttctgttctggattttgacggcgttaattttgctgaatatggtgcggatgcacttccgtttataccaaaatgtgtcgcgagaaaatattagtgatgcgatgactggactgtataatcgcaaaattttaacccctgaactggagcagcggttgcagaaactggtgcaatccggttcttcggtgatgtttattgctattgacatggacaagttaaagcaaataaatgacaccctcggtcatcaggagggggatttagcgattacgttattagctcaggcgattaaacagtcgattcgtaaaagtgattatgccatccgactcggtggcgatgaattctgcatcattcttgtcgattcgacgccgcaaattgcagcacaactgcctgaacgtatcgaaaaacgtctgcaacatatcgcgccgcagaaagagatcggcttctcttccggtatttacgcgatgaaagaaaacgatacgttacatgatgcgtataaagcttccgatgagcgtttatatgtcaataagcagaacaaaaacagccgttcatgataaccttctgtggttgtttgcttgtaatctcaggagcgtgaaatgactgaaatggctaaaggaagcgtgacgcatcagcggttaatcgctttattatcacaagaaggtgctgacttccgcgtcgttacccatgaagcggtaggtaaatgtgaagcggtgtcagaaattcgtggcaccgctctaggccagggtgctaaggcactggtatgtaaagtcaaaggcaatggcgtaaatcaacatgttctggcgatcctcgcagccgatcaacaggccgatctgagccaactcgccagccatataggcggattacgcgcttcgttggccagcccggcggaagtcgatgaactcacaggctgtgtcttcggcgcgatcccccctttcagcttccatccaaaactcaaactggttgccgaccctctactcttcgaacgatttgatgaaatcgccttcaatgcaggcatgctggataaatccgttattttgaaaaccgcggattatttgcgcattgcgcaaccagaactggtcaatttccgccgcactgcgtaactagccggtccgttcgataagaagaacggacaaaaccagtacaacagcaatggcaaaaaacgatgacgtgataatcagtgtctcgacaaacatttgatcgttcatagcatgcccccgggagatagctgttttcacgttattgttagcgtgcacaaatggcagtttgatgacagttcgcctgattttttatgcaaaaaacgtaaagattttctacttccttcctgcagcaagcgtaaagtaagcaggcttattattttttggcaaggaaaccacgatgtttgatgtcactttgctgatcctgctcgggttagctgcgctgggctttatcagtcataacaccactgtcgccgtttcaattctggtgttaatcattgtccgcgtcacaccgttaagcaccttttttccgtggattgaaaaacaggggctaagtatcgggataatcattctgacgattggcgttatggcccccatcgccagcgggacgctaccgccctcaaccttgattcactcgtttctgaactggaaatcactggtggcgattgcagtaggcgtgattgtctcctggctgggtgggcgcggcgtgacgttaatgggcagccagccgcaactggtcgccgggctgctggtaggcactgttttaggcgtagcgctgtttcgcggcgtaccggttgggccgcttattgccgcgggtctggtttcgctgattgtggggaaacagtagttaatctcgcaatatatcggcctggcgtttgccccaggcctttcttaaacatagtaataaaggccgttgttgaatcataccccagcgtatgagcaactttctgtacagtatcgcctttcactaatccctgaagcgccataatcagctgtaactgctgacgccactggcgaaaactcaaccccgtctcttttactatcagtcgggcaagattgcgttcactcatcgcaaaaaagccagcccattgccccaatgccccccactcgacaggccctttcgccatcatctccaccatcgtgcggattttaggatgagaagaaacgggcaggtgcagctgttgttgtggctgctgagggagttcatcaaacaggacctgaattaatctgcgggtcattggctcagcacgctgagtcgtcgtcctgtttgccagggttaaaattaattcccggcataagggcgatattttcaatgtgcaacatgttgtcggcattgtcactgcgctgggttcgataaacagaaaacagagttcagcattagctgttacttgattgctatgttccaccccgcccggtatccaaaccgcatattgtggcggcaccatccacaaagcattttccaccgtacaggtaattgcaccatgtagcgccagtatcagctgtcctttgcggtgctgatgtacaggactggttaactcatccgttccggcgtgaatacaaaatgcgaccgcggcttcatggtgtcggtcgggttcatagccattgagattcaacctgtgcatcattttgtccgaacttagcgataatttgtcattttagcttgattcaacataacaataaaaacggtaaggtacagcctcgtttgtaacaatgagaagcatatgacctgttcaacttcattaagcggcaaaaacaggattgtccttatcgctggcattctgatgattgccacaacattacgcgtcacctttaccggcgcagcaccgttactggatacgattcgttccgcttactcgctgacgacagcgcaaaccggcttattgaccaccctgccattattggcctttgcgctaatctcacctttggctgccccggtagcgcgacgttttggtatggaacgtagcctgtttgccgcgttacttttgatctgtgctggtatcgcaattcgctctctcccttcgccttacttattatttggcggtacagcggtcattggcggtgggattgcattaggcaatgtcttactgccaggattaattaaacgcgatttccctcattccgtcgccagacttaccggcgcatattccctgacaatgggagctgcagcggcactgggatcggctatggtcgtgccgctggctttgaacggttttggctggcaaggcgcgttgctcatgctgatgtgttttcctctgctggctctttttttatggctgccacagtggcgaagtcaacaacatgcaaatttgagtacctcgcgcgccttacatactcggggtatctggcgttcaccgcttgcctggcaggtcacattgtttcttgggatcaactcactggtctattacgtgattattggctggcttccggcgatcctcatcagtcacggctatagcgaagcacaggcgggttcactgcatggtttgctgcaactagccacagcagcacccggtttgctgatcccacttttcttacatcatgtgaaagatcagcgtggtattgcagcgttcgttgccttgatgtgcgcagtgggcgcggttgggctctgctttatgccagcgcacgcgatcacctggactctgcttttcggttttggttccggcgcaacaatgatactggggttgacgttcattggtctgcgggctagttctgcgcatcaggcggcggcactctcggggatggcacaatccgtcgggtatttgttggcagcctgtgggccgccgctgatgggtaaaatacacgatgctaacggtaactggtctgtaccacttatgggtgttgccatactttcactactgatggcgattttcggactttgcgccgggagagacaaagaaattcgctaatatccggtgctatagtgacgtaacaaatcatgcgtgaaagggagaacaaacacgatgaatattcagtgcaaacgcgtttatgatccggctgaacagagcgatggttatcgcatactggtcgaccgcctctggccgcgcggtatcaaaaaaaccgatttagcccttgatgagtgggataaagaaatcacgccgtcaacggaactgcgcaaagcctttcacggcgaagtcgtcgattatgcaacctttcgcgagcaatatcttgcagaactggcgcaacacgagcaagaaggaaagcggctggcggacatcgccaaaaaacagccgctgaccctgctctactcagcaaaaaacaccacgcagaaccatgcgctggtgctggccgactggctacgtagcttgtgattttagtacagcatccggcggttatttttcaccagccggatggtcacgccgccacaatgcccattcatcaatcgtttcaccgcccggtaatttgcaattgttgctgaccccttgcgctgtctgcactggaatgagcgtcccgcccttctgctggcaatagaccgacgccggatttgccataccaatctgcggcggtttaggtgcttctggctgagaaggggttgaacaaccagccaggaccagcaagcaaggcagaacaaaactgataattttcatttattgatctcacatatttatccaagattagagtatcgcggtatcgttttgttttgcagcactatttttattacattcactcaaaacatattacgtcttgtttcatctttgttgatgatgttttatcatgcctgcaaagattaaataatcagcatttacccgccgtatcctggagttgttccgtgtcagatcagattatcgcccgcgtctcgcaatcccttgccaaagaacagtcactggaaagtctggtccgacagcttctggagatgctggaaatggtcactgatatggaatcaacctacctgaccaaagtggatgtcgaagcgcgcctgcagcatattatgtttgcccgtaacagccagaaaatgtacatcccggagaattttaccgtctcgtgggattactcgttatgcaaacgcgccattgatgaaaactgctttttcagcgatgaagtccccgaccgttggggtgactgtattgcggcacgcaatcttggcatcaccacatttctgagcacgccaattcacttaccggatggatcattctatggcacgctttgcgccgccagcagtgagaagcgccagtggagtgaacgcgcggaacaggttttacagttattcgccggactgattgcacaatatattcaaaaagaggcactggttgaacagctgcgcgaagccaatgctgcgctgattgcgcaatcgtataccgactcgttaaccgggctaccgaatcggcgggcgatttttgaaaatctgacgacactgttttccctcgcccggcatcttaaccataagataatgatcgcgtttatcgatctggataacttcaaattaatcaatgatcgttttggtcataatagtggcgatctgtttctcattcaggttggcgagcgccttaatacgctccagcaaaatggcgaagttattggtcgtctcggcggtgatgagtttttagttgtttcactaaacaacgagaatgcggatatttcgtcgctgcgagaacgcattcagcagcaaatacgtggagaatatcacttaggtgatgttgatttgtattatcccggtgccagtcttggcatagtagaagtcgatcctgaaacaaccgatgcagacagtgccctgcatgctgccgatattgcgatgtatcaggagaaaaaacacaaacagaaaacaccttttgtcgcgcatccagcgctacattcctgaggcgtattcacatccttttgattggtgataacatgcgaatcggtattatttttccggttgtaatcttcattacagcggtcgtatttttagcatggttttttattggcggctatgctgccccgggagcataaagatgaaaaaaacaacgattattatgatgggtgtggcgattattgtcgtactcggcactgagctgggatggtggtaacgtcacctctaaaaaatagcaaaggctgcctgtgtgcagcctttgtgcaatttaagcgttaacttttaatcttcctgtagataaatagcacgacaatcgcaccaataacggcaaccacgaagctgccaaaattgaagccatcgactttaccaaagccaaacagcgtgctgatccatccgccgactacggcaccgactatccccagcaggatagtcataaagaatccacctccatctttacctggcatgatccacttcgccagaataccggcaataagcccaaaaataatccatgacagaatgcccattgtttcctcacttatctgttttgcattagcgggttagtcgctgataaaaagcatagcacaacatcgggagggcaagatttgtgacgagcatcacggaggttttttttgcgatggcgcagaaattgcgccatcaacgatcagtgataattaccaaccacaaacatcatgttcgttttccgtgtcataagaacgtacggtattcaccagatcttttatcacttcagccgccacttctggcaccagcaaagtcatcggcgtctctgtttcataatcgacagaaacgccattgctgttattggtgacggtcacggtatacgttgctttgcccatgattcatttcccgttatgaatgactttccgttgttgcgcaccttccatcaggacttcaggagccacgaagaagtcaatgttgaaataagtatcgtcagtcatggcttcaatgttgtgccacttttctggagggaacaccgcaaactgccccgcttcgataaggatcacctgatcaggctctgcactgtgttcatcagcgtagccgagatatttgaccgccccatgcataacggaaaggcgtgggtaaacccccgggcgcgttcctttatcaagatgacgttcgaatattccggcaggtgcagtttgtttattccagaaaggcgttgagcgcgtatgaatataattctgtgggatttgaagcatccttttccctccttcggtgaatgcgctgaaaacggtttattccagccgtttcagggtacgcctgataatttgcattttaaataccatttattggttactttttagcaccatatcagcgaagaatcagggaggattatagatgggaagcccgcgacaacgcgggctgaaagcatcaggattgcagcgtcgccagtcgggcagcgaaacccacgaacatcaaaccaatcagtgagttgccaactttagccagtttctttttggtacgtatgtactgcgtgacaaaagcaccagatataatcaggaagctcaaatagcagaaactcaccagttccagcgtcgccgccagaataaagaatgaaattcccgtatgtggggcattaacatcgataaactgtacgaaaaacgacacatagaacaaaatggctttcggattagtcaggctcaaaattaacgcgcgtttaaaaatagcaccgtattggggctcatcggatttggcctcgctatttttacccttcagggtcgcgtaaagaattttactccccagatagagcaaataaaacgcaccaagataacgtacaatgttgaataatatcggggtggtcttaattaatgtcgccactccagcccatgccagaaacatcaataccgcatcgccaataaatacaccgcaggccgcaagataaccgcctttcataccgctactgacgctatttttgagtacaaacagggtatttggccctggcaccaacacaataaaaatggccccaaccagataggtccagtaattcagaaccccgtattcagcgaacacattaacctctttaattatctttcgatcatgcgcgattaaaggtgaatatgctaaccaatctgtagcggcttagaaaggagaaaatcaggttttaacctgatatcaacccgataattgaatcattaatcaggcatgctccagtgaaaaattcgggtagtgctcggcaaaatactggcgtaaaaattctaccgttatccgcactttcgctgacgtcgccagccttgaaacataaacggcccagacgttcgctggctggtaatattccggtagcacttgcactaaatgaccactggcaatgttttcgctaacatcccaccaggaacgcagagcaatcccctgcccatcgagacaccactgatggacaatttctccatgattagacgacagtgggccggtgactttaatcgcatgggggccttctttattgcgtaattgccagacaccaaaaggatgatcgcgctctttaatgaccaggcacggcaatgcagaaagatcggttaaatgtttcggcgcgccatgttgcgcaataaattccggcgacgcgcagagaatacggtaattggtcgccagtttgcgggcgattaaattaggggcgatgtcatcgccaatgcgaatatcgagatcgacaccttcattgaccaaatcgaccagtcggtcttccacatcaaaacgtaattccagttgcggatacgccttcgccagcgctaataacgccggagccaccacctgtcgtccaaaaccaaagctgctgataatacgcagcatcccctgcggcacctgacgcacgtcagaaagttcgtccatcatctgaccgacatcctgcaaaatccgctgcgcccattcataaatccgctctccttcttcggtaatggtgacgcggcgggtggtgcggtgtaacaacaccacgtttagcgtttgctccagcaaggcgatgcgcttgctgacgaacgccggtgaaacgcccagttcttccgccacggcggcaaaaccagcccggcgagccaccagcataaagacgcgcaaatcattcagcagcggtaaattattcatgattcgtgttttatgtttcaccagttacggggattaattccttttcagtcaattataggatggtgatgttgtcaattttgatggtcaggaagtgagaacccaatgatgaaaacgatgcgtattgctgcgatcccgggagacgggattggcaaagaagtccttcctgaagggattcgcgtgttacaggctgccgctgagcgctggggcttcgccttgagttttgagcaaatggagtgggcgagctgcgagtattacagccatcacggtaaaatgatgccggacgactggcatgagcaacttagccgtttcgacgccatctattttggtgccgtcggctggccggataccgttccggaccatatttcgttgtggggttcgctgctgaaatttcgtcgtgaattcgaccagtacgtcaacctgcgcccggttcgtctctttcctggcgttccctgcccgctggcgggaaaacagcctggcgacatcgatttttacgtggtcagggaaaacaccgaaggcgaatattcctcgctcggcggtagagtgaatgaaggtacagagcatgaagtcgtcattcaggaatcggtatttacccgccgtggtgtcgatcgcattttgcgttatgccttcgaacttgcgcaaagccgtccacgtaagacactaacttctgccactaaatcgaacggtttagccatcagcatgccgtactgggatgagcgagtggaagcaatggccgagaattacccggagatccgctgggacaagcagcatattgatattctctgcgcgcgttttgtgatgcagccggaacgattcgatgtggtggtggcgtccaatttgtttggcgatatcctttccgatcttggcccggcctgcaccggcaccattggcattgccccatccgccaacctgaatccggaacgcactttcccgtcgctcttcgagcctgtccacggttccgcgccggatatctacgggaaaaatattgctaaccctatcgccacgatttgggccggggcaatgatgctcgattttctcggcaatggcgatgagcgtttccagcaagcgcataacggtattctggcagcaattgaagaagtgattgctcacgggccgaaaacacctgatatgaaaggcaatgccaccacgccacaggttgccgacgcgatttgcaaaattattttgcgttaaggtcaaaccagtttatttgaaccgcgtcactgacgcggtttttttattcgttctttgcagtaaataacctgcgtcatttcaccttttattgtttccgtttcgtgttttatggctttccgtattcttaattgtttaatttatgtaacatgcaaattttgttacgcgtacgttaggttccgccgtacaggtattggttttgctggcaatgggactggtgatttatttagccaccagtaaatacggcaatattcgtcttggcgaaggaaaaccggaatacagcacgctctcctggctgtttatgtttatttgtgccggtttaggttcttctacgctttattggggggttgctgaatgggcctattattatcaaacacctggattaaatatcgcaccgcgttcacaacaggcactcgaatttagcgttccctactctttcttccactggggcatcagcgcctgggcaacttatacgctggcctcattaatcatggcttatcactttcatgtgcggaaaaacaaaggtctgagcctttccggcattattgctgctattaccggcgttcgcccgcaaggcccatggggaaaactggtcgatttgatgttcctgatcgccactgtcggcgcactgaccatttcccttgttgttaccgcagcaacctttacccgtgggctttccgcgctgaccggtttacccgataacttcaccgtgcaggcatttgtgatcctgctttccggcggcattttttgcctaagctcgtggattggtatcaacaacggtttgcaacgtctgagcaaaatggttggctggggcgcgttcctgctgccattactggtgctgattgtcggcccaaccgaatttattaccaacagcatcatcaatgccatcggcctgaccacgcaaaacttcctgcaaatgagcttattcaccgatccgcttggcgatggttcatttacccgcaactggaccgttttctactggctgtggtggatctcatacacccctggcgtagcaatgtttgtcacccgcgtttcccgcggtcgtaagattaaagaagttatctggggactgatcctcggcagcaccgtcggttgctggttcttctttggcgtaatggaaagctatgccattcatcagtttatcaatggcgtaatcaacgtcccacaggtgctggaaacactgggcggcgaaacagctgtacagcaagttctgatgtcgttgccagccggtaaattgttcctcgccgcatacctgggcgtgatgattattttccttgcctcgcatatggatgcagtggcctacaccatggcggcgaccagtacgcgtaatctccaggaaggtgacgatcctgaccgtgggctgcgtcttttctggtgcgtggtgatcactctgatcccgctttccatcttgtttaccggtgcttcgctggaaacgatgaaaaccaccgtcgtgctcacagcccttcccttcctcgtcattttactggtgaaagtcggcgggtttattcgctggctgaaacaggattacgccgacattccggctcatcaagttgaacattatctcccgcagacaccggttgaagccctggaaaaaacgccagtgctccctgcgggaaccgtattcaaaggcgacaactgagcgccatcatcctaacgataaaggtatccctatgagcaatctgagccctgactttgtactacccgaaaatttttgcgctaacccgcaagaggcgtggaccattcctgcccgtttttataccgatcagaacgcgtttgaacacgaaaaagagaacgtcttcgccaaaagctggatttgcgtcgctcacagcagcgaactggcgaatgccaatgattatgtgacgcgtgagatcattggcgaaagcatcgtgctggtacgcggtcgtgataaggttttgcgcgcgttctataacgtgtgtccgcaccgtggtcatcagttgttgagcggtgaaggaaaagcaaaaaatgtgattacctgcccgtatcacgcatgggcattcaaactcgatggcaacctggcccatgcacgtaactgcgaaaacgtcgccaatttcgatagcgacaaagcgcaactggttccggtgcgtctggaagaatatgccggattcgtcttcatcaacatggaccccaacgccaccagcgtagaagatcaattacccggcctgggcgcgaaagtgctggaagcctgcccggaagtccacgatctgaaactggcggcccgctttaccacccgcacgcctgccaactggaagaacattgtcgataactatctcgagtgctatcactgtggtccggcgcatccaggtttctccgactccgtacaggttgatcgttactggcacaccatgcacggtaactggacgctgcaatacggtttcgccaaaccgtccgaacagtcgtttaaatttgaagagggtacggatgcggcattccacggtttctggctgtggccgtgcacgatgctgaacgtcaccccgatcaaagggatgatgacggtcatttatgaattcccggtggattctgaaactaccctgcaaaactacgatatttacttcaccaatgaagagttaaccgacgagcaaaaatcgctgattgagtggtatcgcgatgtgttccgtccggaagatttacgtctggttgaaagcgtacagaaagggctgaaatcgcgtggctatcgtggtcaggggcgcatcatggccgacagtagcggtagtggcatttccgaacatggtatcgcccatttccataatctgctggcgcaggtgtttaaggactaatgacatcggcggcggtattttccgccgctgggctgatttttgatggagtacagcaatgtcagactatcaaatgtttgaagtacaggtgagccaggttgaaccccttaccgaacaggtgaaacgcttcacgctggtggcaaccgatggcaaaccattacctgcgtttaccggaggaagtcacgtcattgtgcagatgagcgatggtgataaccagtacagcaatgcgtattcactactgagttcgccgcatgacacctcttgttatcagattgccgttcggctggaggaaaactcgcgcggcggttcccgctttttgcatcagcaggtaaaagtgggcgatcggttaacgatttcaacgcctaataacctgtttgcgctaattccctcagccagaaagcatctgtttatcgcgggcggtattggtatcacccctttcctgtcgcacatggcagagctgcaacacagcgacgtcgactggcagctacattactgctcgcgaaatccagaaagttgcgcatttcgtgatgagctagtccagcatccgcaggctgagaaagtccatttgcatcattcatcaaccggaacacgactggaattagcgcgattattggcggatatcgaacctggcacacacgtttatacctgtggccccgaggcgctaattgaagcggtaagaagtgaagctgcgcgtctggacatcgccgccgatacgctgcactttgagcaatttgctatcgaagacaaaaccggcgatgcatttaccctggtgcttgcccgttccggaaaagagtttgtggtgccggaagagatgactattttgcaggttattgaaaataataaagccgcgaaagtggaatgtttatgtcgtgaaggggtatgcggaacctgcgaaacagcaatactggaaggtgaagctgaccatcgggatcaatattttagcgatgaagagcgtgccagccagcaaagtatgttgatctgttgttcgcgtgcgaagggtaaacgcctggtgttggatttgtagtttgccgaagccggatgtggcgctgagcgcgcccagtccggcttcggaagattttactgcggatattcctgcaataaattgtgtaatgcttccgccatcagctcaccacgccagccggaaatcagctccggcaaattgttctgcggtttcagtttccagtgccagttcagcagttggttgatttgccgacgcgatgccagcaattcggcgctgatcttatgcgtttcgctcacgtcagtaatcagcgacttaatcgctttaaacgctttacgataacccggcatgtccatcaggttaagcatcggctgcggtaaggcatcttccggcaatgtctgcgctttttccaccagcgctagcagcgttttaccgtgaaagcggatttcgctaccggataaacccaggctgtccagttcgcctaaacttcccggcatataacgcgctaccgaccacaaatgctcttcacgcacgacaaagttcaccgccagatcgcgctctcgcgccttgcgcagtcgccagtcggctaacagttgcagacaggccagttggcgtgtgcgtaattgccaggcattggtgatatcacgccaggcatcttccggcgcaacgacttcctgacgacgcatttgcatcaggcggcattcatccagcgccgcaggtagccagccggaggcctccgtttctaccataagcttggcggtgatcggtaacagataccagacatccgccgctgcgtattcacactgacgttcggtcagcggtctggccagccagtcggtgcgcgattcactcttgtccagcgtaacgccggaatactcttccaccatggaagcgaaaccccatgacatcgggcgtccgcagaaggcagcaaggatttgcgtgtcaatcaagggttgtggtaattcgccaaagacattgaggaacacttccagatcttcactgcctgcatggagaaattttgtgatggacggatcgcgcaggatcgctttcagcggtgaccagtcggtgatcccgagtggatcgattagcgccagatgctcgccatcgaaaagttgaatcaaccccagctgcgggtaataagtgcgcgtacgaacaaattcagtatccagggctatcgccggaaaggcacggacggcttcacacaaagaagccagcgcatcgtccgtggtaatcatttggtaattcaaattgttttctctttagtgggcgtcaaaaaaaacgccggattaaccggcgtctgacgactgacttaacgctcaggctttattgtccactttgccgcgcgcttcgtcacgtaattctcgtcgcaaaatttttccgacgttagatttcggtaactcatcacgaaactccaccagcttcggtactttgtatcccgtgagctgacggcggcaaaaagtcaccagtgactcttcggtaagcgatggatcttttttcactacgaagattttcaccgcttcaccactggagccggaaggtacgccaacagccgcgacttcctgtacgccaggatgctgcatgacgacatcttcaatctcgttgggatagacgttaaaaccggaaaccagaatcatgtcttttttacgatcgacaatgcgcaggaatccttcttcatccattaccgcgatgtcgccggtgtgtaaccagccatttttgatgatttcatcggtagcatcgggacgctgccagtaacccagcatcacctgcggtcctttgacacaaagctcacccggttgacctggtggtacttcattatcatcatcatccaccagtttggcttccgtcgacggcaccggcaaaccgatgctaccactatgataatcaatatcatatgggttaacgctgaccagcggcgcacactcggtaaggccatagccttccagcagatactgtccggtcagtttcacccaacgctctgccaccacttgctgcactggcatcccaccgcctgcggaaagatgcagactggagaaatccagctgctggaactctttattgttcagcaacgcattgaacaaggtgttaacgcccgtgatagcggtaaacggatatttcgctaactcttttaccaaccctggaatatcgcgcgggttagtgataagcaggttctgcccacccagttcgataaacagcaggcagttaatggtcagggcaaaaatgtgatacagcggcagcgccgtcaccaccagctctttgcccggatgcaacagcggaccataggtcgcgttaacctgttccaggttcgccagcatattgcggtgagtcagcatcgcgcctttcgccacaccagtggtgccgccggtgtattgcagaaaagctaaatcttccggcaccagttcgggtttgacgtactgcatccggtagccgttatgcagtgcgctacgaaatgaaatggcatctggcagatggtatttcggcaccaaacgcttgatgtatttaacaacgaaattgactaccgtgccttttgccgtagatagctgatcgcccatacgggtcagaattacgtgctgaacggcggttttatcaaccactttttccagtgtgtgagcaaagttagacacgataacaatcgccgatgcgccgctatcgttaagctgatgctcaagctcacgcggggtatacaacgggttaacgtttacgacgatcatcccggcacgcaaaatgccaaacagcgccaccggatattgcaataaattaggcatcatcaacgcaacgcgatcgcctttcttcagccccaacccttgttgcaaataagcggcaaacgcgcgactgcgttcttccagcttgcggaaggtcattacctcccccatattcacaaacgcaggttgatcggcgtagcgcgcgaccgactgctcaaacatatctaccagagattgataacggtcagggttgatctccgtcggaacgtccgcgggataacggttaagccaaaccttcttcaattcttcacctctaaaatgcgtgttcgtcgtcatcgcaaccccaaatgatatacatgccgttaacataatattaactcatcataccagcttgataattacccaacgaaaaggttgcgaagcgcgtcactatttatttttatctttaccgtaagaatgcagaaacagcggaccagccgctgtttctttttctttaaaaacaagcaattattcagttacaactgtttgtactctcgcggggccgggattataccagccccatccgccgtagccatagggccagccacgaccgccataaaaccatggatcaatcggctgaggcggcataatcacctgctgggttaaatgccaacgtttgtaacccgttacttgcatcaccataaatttatagggcgtattgccgattttgccgtcaaccgcaccagtgattggcccgactaccgtaaccagttgtccacggaaatccaccgggtccagaaaaccgttcacatcggcataaatgcgaccgcgagaaggttctcccagcgtcggtctggctccgctgtccagcggtacggtagcaatttccaggcgagttttcccttgctggttttgtaccgcaaccactttgccaccaaagcgtgcctcctgaccaacgtacagctgcggcgcactcatcacccgaactaaatcttgttgcggcgtgggactgctgcctttaatggcgtccggcacagtgacacaaccgctcagcattagcgcaaacgtacctgccagtatgcctttgataacattcttttgaaccgccatggtgcgactcctttttttctcagggcatactcttaagattcattctttgcccggaagtttcttccatgcgacgttgttacgtaaataaaccggttcggcatgttccaccgccaccgttttaccctcagcaaacatctgacacgcaatcggcagcatatcttcagcagcaggcagtaacacttcgccatcgcgcaaaaccagcccgctctctttaccgagatccggccaagcttgccagcccgtccctaccgtcacccattcgccggaaagctgttgcattcgttcatggacgatttcgggtttgagtacggcttcggtttcttcaccgtgccagataccgttttcatcacgctgatattcggcccagtaaacttcgcccattcgcgcgtcaatggctgccagcacgcgggttgcgccgtttttgcgccacgccccttgcgccatcgtcattagcgtggagacgccaatcatcggtaattccgcgccaagcgccagcccttgcgcgatgccaataccaatgcgcacgccagtaaagctaccggggccgcgcccgtaagccagagcgttaatatcagtcagggaagttccgctggtggtcaggatatcctgcaccatcggtaagattcgttgagtatgttcacgagggcaaagctcaaaatgagcgttgacagtaccgtcgttccacagggcgacagagcaggcctctgtcgcggtatcgatagccagaattcgcatgggtcttcgtgcttagatcaataaaaaggcgcgcatcataccatactccgtaacaaattacctggaggatggtatcgcaaggaaacgaaccgcacgggcaatgtcacgggtgcgtggcgcgggcggcagactggcgagaaacgtcgcgccgtaaggacgcatcaccagccgattgtcacaaatcaccagcacgccacgatcgtcggcgtcgcgaatcagtcgccctaccccctgtttgagagtaatgacggcatctggtagttgcacttcatcgaacgggtcgccaccgcgcaaacgacaatcttccatgcgcgcttttaacagtggatcatccggcgaggtaaacggcaatttgtcgataattaccaatgacaatgtatcgccacgcacgtccaccccttcccagaaactgctggttgccacaagaagcgcattaccggcgctgacaaattgctgcaacagttgccctttgctggtttccccctgcaacaatacaggaagcgtcatggtagcgcggaactgctcggccagatcgcgcatcatggcgtgcgaggtacaaagcataaaacaacgaccgttgttagcttcgatgatcggtcgcagcattgccgctaactggcgagcagaacctggctggttggtttgcggcagattgcgcagcacacagagtaacgcctggcggctgtaatcaaatgggctgggcaacagcaacgactcggcctgttcgatgccaagccgcgaggtgaaatgatgcagatcgtcgttcaccgacagcgttgctgaggtgaagatccagctaccgggtttttgcgccattaactctttgaatttatccgccacgctgagcggcgtgagagccagagtaaaatggcgcgaagtgcattcgtaccagtagctgtagcccggctgattgatctcttttagccgcttcagccgtgtgcgatacaacgtggcgcgctcaaatgccgcatccagcaaggcggaacgccccagtgacagtttcgccacgtcataacaaagttccagggtgtcatcgagcagtaaaaatgcccgctgaatttgcggattagctaacagctcacgcaggttaccgcgataacctggctcaccgagttgcagacgaaaatcctgcgcactctgggcaagacgatcagcgcacttttgtaactgctgggtgtcttttaattcggtgcggtaggcgatggtgatgtcttttgccaggtcgagcagttgtcgactggagagtgactgaccaaaatactggctggcaatgtccggtagctggtgggcttcgtcgaagatcatgacgtccgcttccgggatcagttcgccaaatccactctctttaaccaccatatccgccagaaagagatgatggtttaccaccaccacatcggcgtccatcgcttttttacgtgctttgaccacaaagcaatctttatacatcgggcagtcgctgccaagacagttgtcgttggtgctggtgaccagcggccacgcctgtgaatcttccgccacgctgacgcaggtgctgatatcaccatcgactgtttgattagaccaggagcgcagcaggatcacatcgcttaagatttgtaccggcagatcgccccccgccagcgcctgctgttcgagacgttcgaggcagaggtagtttgagcgccctttcagcagcgccacgttgcccgtatatttcaatgcctttgagactgttggcaaatcgcggctgtagagctgatcctgcaacgcttttgagccggtcgagataatgactttctttttcgcccgcagcgcaggagccaggtaagcgtaggttttgcccgtaccggttcctgcttccaccaccagcggctggcctttttctatcgcctgggtgacggctaccgccatctgtcgctgtggttctcgcggcttaaagcctggtatcgctttcgccagctgaccgtctggtgcaaaatcgtccgtcacactaccccctgttgatttgaacagggattatgtcaggatgagggcgctttcgccagttgaagtggtgacggcgacctcacattgtggcagtctttgcagcacgaaaatggaagtataatgaggacaaaatgatgactatcgttcgtatcgatgctgaagcccgctggtctgatgtagtaatccacaacaacacgctctactacactggtgtaccggaaaacctcgacgccgatgcctttgagcaaaccgccaacacgctggcacagattgacgccgtgctggaaaaacagggcagcaataaatcgagcattctggatgccaccattttcctggccgataaaaacgacttcgcggcgatgaataaagcgtgggatgcttgggttgtcgcgggtcatgcgccggtgcgctgcacggtacaagcgggtttgatgaacccgaagtataaagttgaaattaagattgtggctgcggtgtaagctttatcgaagcaaaataagtcagacgataatttatcgataatactggtcggttttacataaatcgaccagagaataagatattactgttgatgcttctgctaattcattatttatatttataatttcaattttatctataaaactaactatataaataaacataaacatgccgttgtgttcgccctttgattagcaactctggttttctttcttagctgaacaatctggttatagcgtgcggactgaccgttaaatttctccatcttactggataacacaccatgagctgctacctttaaaacacctgaatgtcaacaggttaactcgtgccatatcgttataatccctttgatattagatgcaaattaaggtcatatatagccttatcgataacatggttaattttaaggataagaatatgcctgctgtaatagataaagccctggatttcattggtgccatggatgtatcagcgccaacaccaagttcgatgaatgaaagcacggcgaagggaatctttaaatatttaaaagaactgggagtacccgcgagtgccgctgatattacggcgcgagctgaccaggaaggctggaaccctgggttcacggaaaaaatggttggatgggcaaaaaaaatggagacaggtgaacgttctgtgattaaaaatcctgaatacttttcaacatatatgcaggaagaactaaaagcactggtctgagttaaatttatatcagcataaatgggtcaggacgcttttaatcacatataaaaagcgtcctttttctcacaatcaaatgatcatcggcttctataacgaaatcgatacggattagtgtgttactcgtcttcatcctcaaaacgcgccacgattcgctcgccggagtggttggcacgcagctcttctgccaccagcgcgattgcctggccgctgctcatcccttgtgccatcagttcctggatccgctcgacagctttttgctgctgttcatgggtgagtgaaggtaaacctgcaaacattgttaactcctgctaaattgttggcgctaattatttcatgctacccggcacatagccagtagagtcaggactgatgaagacgttatctcccgctgtgattactttactctggcgtcaggacgccgctgaattttatttctcccgcttaagccacctgccgtgggcgatgcttttacactccggctatgccgatcatccgtatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccaacgcataacgaagatttgccatttcagggcggcgcactggggttgtttggctacgatctgggccgccgttttgagtcactgccagaaattgcggaacaagatatcgttctgccggatatggcagtgggtatctacgattgggcgctcattgtcgaccaccagcgtcatacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccaacgttttcatgcgacctattctggcgatgaatggcaggcattccttcagcttaatcaggccaaccgcgcgccatttagcgcttttttacgtcttgaacagggtgcaattttaagcctttcgccagagcggtttattctttgtgataatagtgaaatccagacccgcccgattaaaggcacgctaccacgcctgcccgatcctcaggaagatagcaaacaagcagtaaaactggcgaactcagcgaaagatcgtgccgaaaatctgatgattgtcgatttaatgcgtaatgatatcggtcgtgttgccgtagcaggttcggtaaaagtaccagagctgttcgtggtggaacccttccctgccgtgcatcatctggtcagcaccataacggcgcaactaccagaacagttacacgccagcgatctgctgcgcgcagcttttcctggtggctcaataaccggggctccgaaagtacgggctatggaaattatcgacgaactggaaccgcagcgacgcaatgcctggtgcggcagcattggctatttgagcttttgcggcaacatggataccagtattactatccgcacgctgactgccattaacggacaaattttctgctctgcgggcggtggaattgtcgccgatagccaggaagaagcggaatatcaggaaacttttgataaagttaatcgtatcctgaagcaactggagaagtaagacgtggaataccgtagcctgacgcttgatgattttttatcgcgctttcaacttttgcgcccgcaaattaaccgggaaaccctaaatcatcgtcaggctgctgtgttaatccccatcgtccgtcgaccgcaaccggggttgttgctgactcagcgttcgattcatctgcgtaaacacgctggacaagtggcattccctggaggtgcagtcgatgacacggacgcatcagctatcgccgccgcgctgcgcgaagctgaagaagaggtcgctataccgccttccgccgttgaagttatcggcgtgctgccgcccgtcgatagcgtcactggctaccaggtaaccccagtggtcggcattatcccgcccgatctgccgtatcgcgccagtgaagatgaagtctcggcggtgtttgaaatgccgctcgcccaggcattacatctgggtcgttatcaccctttagatatctaccgccgtggtgattcacatcgggtatggctgtcctggtacgaacagtattttgtatggggaatgaccgcaggcataattcgtgagctggcgctgcaaattggtgtgaaaccctgactatacttatctttacatctacaaaacactacttgagacaatcatcgcaatattagttaaatcgcggtttttgattagtttaattcatgtgaatagttaagccagtcgccgcgttccctcttacactatgcgctgttattagttcgttactggaagtccagtcaccttgtcaggagtattatcgtgattagtctattcgacatgtttaaggtggggattggtccctcatcttcccataccgtagggcctatgaaggcaggtaaacagttcgtcgatgatctggtcgaaaaaggcttactggatagcgttactcgcgttgccgtggacgtttatggttcactgtcgctgacgggtaaaggccaccacaccgatatcgccattattatgggtcttgcaggtaacgaacctgccaccgtggatatcgacagtattcccggttttattcgcgacgtagaagagcgcgaacgtctgctgctggcacagggacggcatgaagtggatttcccgcgcgacaacgggatgcgttttcataacggcaacctgccgctgcatgaaaacggtatgcaaatccacgcctataacggcgatgaagtcgtctacagcaaaacttattattccatcggcggcggttttatcgtcgatgaagaacactttggtcaggatgctgccaacgaagtaagcgtgccgtatccgttcaaatctgccaccgaactgctcgcgtactgtaatgaaaccggctattcgctgtctggtctcgctatgcagaacgaactggcgctgcacagcaagaaagagatcgacgagtatttcgcgcatgtctggcaaaccatgcaggcatgtatcgatcgcgggatgaacaccgaaggtgtactgccaggcccgctgcgcgtgccacgtcgtgcgtctgccctgcgccggatgctggtttccagcgataaactgtctaacgatccgatgaatgtcattgactgggtaaacatgtttgcgctggcagttaacgaagaaaacgccgccggtggtcgtgtggtaactgcgccaaccaacggtgcctgcggtatcgttccggcagtgctggcttactatgaccactttattgaatcggtcagcccggacatctatacccgttactttatggcagcgggcgcgattggtgcattgtataaaatgaacgcctctatttccggtgcggaagttggttgccagggcgaagtgggtgttgcctgttcaatggctgctgcgggtcttgcagaactgctgggcggtagcccggaacaggtttgcgtggcggcggaaattggcatggaacacaaccttggtttaacctgcgacccggttgcagggcaggttcaggtgccgtgcattgagcgtaatgccattgcctctgtgaaggcgattaacgccgcgcggatggctctgcgccgcaccagtgcaccgcgcgtctcgctggataaggtcatcgaaacgatgtacgaaaccggtaaggacatgaacgccaaataccgcgaaacctcacgcggtggtctggcaatcaaagtccagtgtgactaatacttcttactcgcccatctgcaacggatgggcgaatttatacccgctttctcgtctgctgtaatattccccactacacttccactgttgcgtcaggcgtttgtcgccatacgcttacagggtggcccgcatgcaaaaagcacaacggatcattaaaacctatcgtcgtaatcgaatgattgtttgtacgatttgcgcactcgttacgctcgcttcgaccctgagcgtgcgatttatttcacagcgtaacttaaatcaacaacgggtagtacaattcgccaatcacgctgtagaggaattagataaagtactgcttcccctacaggcaggtagcgaagtcttgcttccgctgattggtctgccctgctctgtcgcccatttgccattacgtaaacaggcggcaaaactccaaactgtgcgatccattggcctggtgcaagacggcacactttattgctccagcatttttggttatcgcaatgtgcccgtcgtggacattctggctgaacttcctgcaccgcaaccacttttacgcctgacgatcgaccgtgccctgattaaaggcagtccggttttgattcaatggacgcctgcagcgggcagtagcaatgctggggtcatggagatgattaacatcgacttactgacggcaatgctgcttgagccacaactgccgcaaatcagtagcgccagcctgacggtggacaaacggcatttgctctatggtaatgggctggtagattcccttccgcaacctgaagacaatgaaaactatcaggtttcttcgcaacgctttccttttaccattaacgttaatggtccgggggctacggcgctggcatggcactatcttccaacacaattaccgctggcggtgctgctaagtttactggtgggctacatcgcctggctggcgaccgcttaccgaatgagcttttcccgcgaaatcaatctgggcctggcgcaacatgagttcgaattgttctgtcagcctttgcttaatgcgcgcagccagcaatgtattggtgtagagattttgctgcgctggaacaatccgcgtcagggctggatttcaccggatgtgtttattcctatcgcggaagaacatcatttaattgtgccactgacccgctatgtgatggcagaaaccattcgtcagcgccatgttttcccgatgagtagtcagtttcatgttggcattaacgtcgcacccagccattttcgccgtggtgtgctgataaaagatctcaatcagtactggtttagcgctcacccgattcagcaactgatcctcgaaatcaccgaacgcgatgccttactggatgttgattatcggattgcccgcgagctgcatcgtaaaaacgtcaaactggcgattgatgacttcggcaccggcaacagctcgttttcctggcttgaaacattacgtcctgacgtgctgaaaattgataagtcatttaccgcagctataggttctgacgcggttaactcgacggtgaccgatatcatcatcgcgctggggcaaagactgaatattgaactggtggcggagggcgtggaaacgcaagaacaggcgaagtatttgcgccgtcatggcgtgcatattttgcaagggtatttgtacgcacagccgatgccgctacgtgattttcccaaatggctggcgggcagccaaccgccgcccgcccggcataatggacatatcacgcccattatgccgttacgttaacgcttactcatcttcatcgtgcgccggttgctctttaacaatgcgaaccagatcaacacgataatcattggcttcaatgatggtgatatgcagtggccctacatcaatcacatcgcccacacggggaatgtgaccatttgccgagatcacgaggcccgcgaccgtcgcgatatcatcgtcatcggcaaggtgctcaacatcaagcgcctgctgcaaggcatgcaaatctgtaccgccttttaccagccagccgtcaccatcagtaatgatttccggcgtttcgtcagcgtccgggaattcacccgcaatggcttccagcacatccagcggcgtgaccagaccttgtaccacaccaaactcgttggtcacgataacaaagctcccgcgagcacgacgcagcacgcccaacaggttgatcggatcgagggtttccgggacgataatcgccggagacgccgaagcaatcgccgccacatcaacgccctcttccagcgccaccagcagttctttagcacgtacaataccgatgatttcatccagttcaccgcgacataccgggaacagactgtgcggtgaagagagcagttgctcgcggatttcatcgaccccgagattagcgtcaacccagcttatttcaccgcgcggcgtcatgatcccgcgcagagaacgcgacgccagcgtcagtacgccgttaatcatgtaacgttcttcttcggcaaatgcaccttccgggatcggcatcggcatcgggttatcggcatcgtgctgaacattggcctgacgtttcccgcccatcaaacgcaggatggcatcggcagtacgcgctcgcagcggcaaagtcgactggtggcgaataaagttgcgacgcgcaatctggttaaacacttcgatgatgatcgagaagccaatcgcggcatacaggtaacctttcggaatgtggaaaccgaaaccttctgccaccagactcagaccaatcattaacaggaagctcagacagagcaccaccaccgtggggtgctggttaacgaatcgcgtcagcggtttggatgccagcaacataaccgccatcgcaatcactaccgccgccatcatcaccggcagatggttaaccatccctactgcagtaattaccgcatccaacgagaagacggcgtcaaggatgacaatctgtgtgacgaccacccagaaactggcgtagcctttaccgtggccggaatcatgatcgcggttttccagccgttcatgcagttcggttgttgctttgaacagcaagaatatccccccgaacaacataatcaggtcgcgtccggagaaggagaaatccatgacggtaaatagcggtttggtcagcgtgaccatccatgaaatcagcgacagcagccccagacgcataatcagcgccagtgataaccccagcaaacgcgctttatcgcgttgttttggcggcagtttgtcagcaagaatggcgatgaagaccaggttatcgatacccagcacaatttcgagaacaacaagcgtgagtagccccgcccaaattgaggggtccattaagaattccatgacaagctcctgcttaaggaatagctattcgacgccagaaataatgcaggcgtaacgacaaaatgcaaacgaaaggtgcggcatagagtgccagaaaggcaggcgttaaaaggcctgatgctgaaatgacgtcggtgacgatccatactgcgggctactgccctatactccatggttgttaaacgggagttaaacatatcagagacgcctctgatttggcaaagatttaccttcctttgcaaacgaatgtgacaaggatattttacctttcgaaatttctgctaatcgaaagttaaattacggatcttcatcacataaaataattttttcgatatctaaaataaatcgcgaaacgcaggggtttttggttgtagcccttatctgaatcgattcgattgtggacgacgattcaaaaatacatctggcacgttgaggtgttaacgataataaaggaggtagcaagtgaccattgctattgttataggcacacatggttgggctgcagagcagttgcttaaaacggcagaaatgctgttaggcgagcaggaaaacgtcggctggatcgatttcgttccaggtgaaaatgccgaaacgctgattgaaaagtacaacgctcagttggcaaaactcgacaccactaaaggcgtgctgtttctcgttgatacatggggaggcagcccgttcaatgctgccagccgcattgtcgtcgacaaagagcattatgaagtcattgcaggcgttaacattccaatgctcgtggaaacgttaatggcccgtgatgatgacccaagctttgatgaactggtggcactggcagtagaaacaggccgtgaaggcgtgaaagcactgaaagccaaaccggttgaaaaagccgcgccagcacccgctgccgcagcaccaaaagcggctccaactccggcaaaaccaatggggccaaacgactacatggttattggccttgcgcgtatcgacgaccgtctgattcacggtcaggtcgccacccgctggaccaaagaaaccaatgtctcccgtattattgttgttagtgatgaagtggctgcggataccgttcgtaagacactgctcacccaggttgcacctccgggcgtaacagcacacgtagttgatgttgccaaaatgattcgcgtctacaacaacccgaaatatgctggcgaacgcgtaatgctgttatttaccaacccaacagatgtagagcgtctcgttgaaggcggcgtgaaaatcacctctgttaacgtcggtggtatggcattccgtcagggtaaaacccaggtgaataacgcggtttcggttgatgaaaaagatatcgaggcgttcaagaaactgaatgcgcgcggtattgagctggaagtccgtaaggtttccaccgatccgaaactgaaaatgatggatctgatcagcaaaatcgataagtaacgtattgtgttgattatcactcagttttcacacttaagtcttacgtaaacaggagaagtacaatggagattaccactcttcaaattgtgctggtatttatcgtagcctgtatcgcaggtatgggatcaatcctcgatgaatttcagtttcaccgtccgctaatcgcgtgtaccctggtgggtatcgttcttggggatatgaaaaccggtattattatcggtggtacgctggaaatgatcgcgctgggctggatgaacatcggtgctgcagttgcgcctgacgccgctctggcttctatcatttctaccattctggttatcgcaggtcatcagagcattggtgcaggtatcgcactggcaatccctctggccgctgcgggccaggtactgaccatcatcgttcgtactattaccgttgctttccagcacgctgcggataaggctgctgataacggcaacctgacagcgatttcctggatccacgtttcttctctgttcctgcaagcaatgcgtgtggctattccggccgtcatcgttgcgctgtctgttggtaccagcgaagtacagaacatgctgaatgcgattccggaagtggtgaccaatggtctgaatatcgccggtggcatgatcgtggtggttggttatgcgatggttatcaacatgatgcgtgctggctacctgatgccgttcttctacctcggcttcgtaaccgcagcattcaccaactttaacctggttgctctgggtgtgattggtactgttatggcagtgctctacatccaacttagcccgaaatacaaccgcgtagccggtgcgcctgctcaggcagctggtaacaacgatctcgataacgaactggactaacaggtgagcgaaatggttgatacaactcaaactaccaccgagaaaaaactcactcaaagtgatattcgtggcgtcttcctgcgttctaacctcttccagggttcatggaacttcgaacgtatgcaggcactgggtttctgcttctctatggtaccggcaattcgtcgcctctaccctgagaacaacgaagctcgtaaacaagctattcgccgtcacctggagttctttaacacccagccgttcgtggctgcgccgattctcggcgtaaccctggcgctggaagaacagcgtgctaatggcgcagagatcgacgacggtgctatcaacggtatcaaagtcggtttgatggggccactggctggtgtaggcgacccgatcttctggggaaccgtacgtccggtatttgcagcactgggtgccggtatcgcgatgagcggcagcctgttaggtccgctgctgttcttcatcctgtttaacctggtgcgtctggcaacccgttactacggcgtagcgtatggttactccaaaggtatcgatatcgttaaagatatgggtggtggcttcctgcaaaaactgacggaaggggcgtctatcctcggcctgtttgtcatgggggcattggttaacaagtggacacatgtcaacatcccgctggttgtctctcgcattactgaccagacgggcaaagaacacgttactactgtccagactattctggaccagttaatgccaggcctggtaccactgctgctgacctttgcttgtatgtggctactgcgcaaaaaagttaacccgctgtggatcatcgttggcttcttcgtcatcggtatcgctggttacgcttgcggcctgctgggactgtaagactgttgtacactaccggggccttttggccccgtttttttatctggaggattaatgacaatcacggacctggtactgattcttttcatcgccgcactcctggccttcgcgatctacgatcagttcatcatgccccgccgtaacggccccaccctgctggcaattcctttgctccggcgtggtcgcatcgatagcgttatcttcgtcggattgattgtcattcttatctataacaacgtcacgaatcatggtgcgttaataacgacatggttattaagcgcactggctctgatgggtttttatatattctggatccgcgttccgaagatcatctttaaacaaaaaggttttttcttcgccaatgtctggattgaatatagccgaatcaaagcgatgaacttgtcggaagatggcgtgttggtgatgcaattagaacagcgtcggctgttaatccgcgttcgaaatatcgacgatctggaaaaaatttataagcttctcgtttcaactcaataagttatgaatttagccaaagctatgtttagtgtatttttaataatcagacatagcttaggctatattacctcttcccttatttgttatttattttaacgtttcattgatatataaatccaaatgaaaatcgttatcaataaagcaatgaaataatatattccaacagttgttttatattctcaaaatatgttaaggttgcgccctcatttggggagtagccgatttccagattccggaaatgtacgtgtcaacatactcgttgcaaaacgtggcacgtacggactgaatactttcagtcaggcgagaccatatgcacatcaatcgctatgcctgcatgaacgcgaaaaccatcacggcttgttgttcatgtatgcatgtttgctgggggcgatgatgtgttttatggataccccggtcaggacattgtcatgaatatcactgctactgttcttcttgcgtttggtatgtcgatggatgcatttgctgcatcaatcggtaaaggtgccaccctccataaaccgaaattttctgaagcattgcgaaccggccttatttttggtgccgtcgaaaccctgacgccgctgatcggctggggaatgggcatgttagccagccggtttgtccttgaatggaaccactggattgcgtttgtgctgctgatattcctcggcgggcgaatgattattgagggttttcgtggcgcagatgatgaagatgaagagccgcgccgtcgacacggtttctggctactggtaaccaccgcgattgccaccagcctggatgccatggctgtgggtgttggtcttgctttcctgcaggtcaacattatcgcgaccgcattggccattggttgtgcaaccttgattatgtcaacattagggatgatggttggtcgctttatcggctcaattattgggaaaaaagcggaaattctcggcgggctggtgctgatcggcatcggcgtccagatcctctggacgcacttccacggttaataagaacgctgccagaggtgaatattaaagtccgtctggcagtcgaacacttcttttgctgccagtgtttgccagacttctggcttcgcacgccaggcaaacggcgtcatctgcaataatgcgacggcttcatcaccgcgaagacgcatcggataacacaactccgcactctgctgtaatgtaaaaccttccagttgttctgcatgaggtgcatgaagatgtacttcattgtaaatcagccccttcagctccatcaaatgtcgcggtcccggcgtggcagtaatgacccagccgccgggcttcactactcgtgctaattcttctgctttacacggcgcgtaaatacgtattatggcgtccatactggtatcggaaaacggcaaacggtggctggaagcgacacaaaaagtgacctgcggatagcgtttcgccgccgcttttatcgctaccttcgaaacatccagaccaaacgtggtgatttcgggcaacgcatcggcaaatgcgtgtgtgtaatacccttcaccacagccaatatccagcaccgccgtggccttatcatcaagccgttccctcagttgggcgacaattgcatcacgcagcggctgataatgtccggcatctaagaatgcgcggcgtgcttgcatcatttccgcgctgtcgcccggatcacgagaccgtttatgctgaacgggcagcagattgacatacccttctttcgccatatcaaactgatgtcgctggggacagatatagctgtttttttcacgcgaaagaggctgatggcaaagtggacaggaaaaagacatgacaactccggcaggatactaaaggccgcaagtgtaacgcgaatcacgcggcgggcaaatatccgaacgccaggagcgaagataaagcatagtaaaaagcctcgcattcgacgaggctttatagcgagattgaagcgtattcacacttcagatcagtggattcgatcagatagctgttacgttaacagctgccggacctttctggccgtcctgaatttcgaactcaacgttctgaccttcagccagagttttgaagccattaccctggatagcggagaagtgtacgaacacatctttgctgccatcagccggagtaatgaagccaaaacctttagactcgttgaaccacttaacctgacctttaatctttgccatttgaaaaattccttagattgttttcttcgcccgcaggcataacatagataaaactgacacattactgcatgaggcaccaatataaggctcggcagagaagcggtattcaacgtcaacgtgtttactcaggacttctttactgaaaatgccacacataaacagaactgtacctcgtttaacccgaaatctgttatcacatacaacgttaattatggcaagccatttttaaacatgtctcgatcagacgcacaaatctcgatacgtcttccactttttttgcacacttatgcaacggaatacgcgccgatatatcattgtgcttaaccttgccagttcaggcagatacttaaactggcgtattttctaacatagttcaataagttcagttgttccaggccagtgggagaagttattacatagtgcgtgcaatatcacattttttgctatgcaatgaataaaaagttatatcactttttctcataaaacagtcagttaacggctattaattaccctaaagagaagtcaatccccaaagggattgtaaatttaaaataagaaaaattgatgaatgagcaaaaaaatcaagagagaaacgtttcgctaataaataataccacgcttaatcacaaatccgatgtaaacatcctaataaattaatggggtaaatatctttttctgatatcccgttacgcaaataaataatatgataattatttgaagtcagaccagagttttaatttgaagcagttgcaccatgacagtgcgtataatcaggatgaattgagtaacccttcaacgacggggttactcaagattgaggaaggattatcgttcggcgaccagacgaataatatcttcgtcttcaaccgatttttgactctcaacggtctttttatctgctttctctggttcgtttgcttcgcacaaacgacgtaacagtgcattttgacgtttttgctgatccagcaacgcctcaagcagttcaatctgttcgttagtccgtgaactggcacgattgataaaaaaccacaagatgagcccgataagaagaaccaccaccgatacaaccaaagacgcaatgttcatcacgcctgaatttacaacttcgttcatttcaccacctctgagtagaggcgctattctaccactgctggagaggaagaaaatctagtgctgaaaaaatgatatcaccacgggataaactggttaatggcacaaattccgctgaaaaattgtacatcctgatcgcacatcatgttgaatacctgcgcccaaagcagcaagcaagccaacaccacgacaaccagaacgacccatcgaaactttttcactccaatctccgtttcacctaccttatgtcattaaactagcatgcgttagttaaacagcgcctaactatgtcgatattcgtgctttttcggaatgagtcgcttgcttcagcgcatattgccgctacgattaagcgaacataaaaagagaagaggttgtaatgcgattcatcattcgcacagttatgctgatagcactggtatggataggattattactcagcggatatggcgttttgattggaagcaaagagaatgccgcaggattaggtttgcaatgtacctatctgactgccagaggcaccagcacggtacaatacttgcacactaaaagtggttttttggggataacagattgcccgctgttacgcaaaagcaatatcgtggtcgataatggttaagggcaataaataaccagattctcactcctgagtaaaatactcttatagcaagcgcgtttaatataacgccaccttcaactttatttttctcatgctaaataaagaacctgtctgtttgatattccgacaggttcttactctcatcagaacggatagtcgtgataacccatttgggcagaaattttgcgcgctgcggtatgcaacattgcgacatattcctgtaaacgctcttcagagaaacgcaacgtcgggaaggagatgctcaaaccggcaatgaccacgccaaagcgatcaaataccggtaccgcaatgcatcgcagcccttcttcctgctcttcattatcttcgccatacccctgctcgcgcacctggtccagaacgggtaataacgcttctgtactggtgatggtccgctcggtactgcgtttatactccacgccctcaagaatttgcttcacttcatcgcgatcgcgccatgccagcagtaccttaccaatcgcggtgctgtacagcggattacgacgcccaatccgtgaatacatgcgcaaattgtacatagagtcaattttgtgaatgtaaacaatactgtcttcgtccagtgcgccgaggtggatagtttctttggtcaggcgggagagctcacgcatctggatatctgcgctacgaattaaatcgacgttttgtaacgcgcgagcgcccagttcaaacaatttcagggtcagggaatatttctccgactccccttcctgcgccacataacctaaggttttcatggtctgtaaaaagcgataaacggtgctttttgacatcatgacgcgctgcgacagctcggttatccctatttcgcgctcttcacccagcgcctgcaaaatgccaaaaacttttagcacggaagatacagaatcaggctgtttatccagatctgcgttagccatttatcacctcattgcgagtgttttataaaaatcagaactgttttttattataatttcgcaccagggtggtcgcaatccatcttttgccggttagttacaattctgcgacatccaccgtgaatatcagtgctagaatcatacccctgttgattattcaccaaagatataaaattcctatgccaaaagttcaggccgacggcctgccattgccccagcgatacggtgcgatattaaccattgtgattggtatttcgatggccgtccttgacggcgcaatcgccaacgtcgccctgccaacaatcgccacggaccttcatgccacgccagccagttccatctgggtagtgaacgcctatcaaatcgccattgtcatctccctgctctcgttttcgtttctgggcgatatgtttggctatcgacgtatttataaatgcggtctggtcgtttttctgttgtcttcactgttctgcgccctttctgattcgctgcaaatgctcacccttgcgcgtgtcatacaaggtttcggcggtgcagcgttgatgagcgttaataccgcacttatccgcctgatctatccacaacgttttctgggtagagggatgggcataaactcgtttattgttgccgtctcttctgctgccgggccgacaattgctgcagcaatcctctccatcgcatcctggaaatggttatttttaatcaacgtaccgttaggtattatcgccctgcttctggcgatgcgttttctgccacccaatggttctcgcgccagtaaaccccgtttcgacctgcccagcgccgtgatgaacgcgttaaccttcggcctgcttatcactgcgttgagtggtttcgctcaggggcaatcgctgacgttaattgctgcggaactggtggtaatggttgttgttggtattttctttattcgccgccagctttctcttcccgtaccgctgctaccggtggatttactgcgtatcccgctgttttcactttctatttgcacatctgtttgctctttctgcgcacaaatgctggcaatggtttccctgcccttttacctgcaaaccgtgctcgggcgtagtgaagtcgaaacaggtttacttctgacaccgtggccgttagcaacgatggtgatggctccgctggcaggctatttgattgaacgcgtacatgcaggattgctgggggctttagggttgttcatcatggctgcggggcttttttccctggttctgctgcccgcgtcacctgcggatatcaatattatctggccgatgatcttatgtggtgctggatttggcttattccagtcacccaataaccacaccattattacctccgcgcctcgcgaacgtagcggtggagccagtggcatgttaggaacggctcgtctactgggtcagagtagcggcgcggcgctggtggcgctgatgctaaatcagtttggagataatggtacacacgtctcgctgatggctgcggctattctggcagtgattgctgcctgtgtcagtggtttacgtatcactcagccacgatccagggcataaaaaaagcgcgtcgatcaggacgcgctttttagtatttacttcatattacttcaggtattcacccgtacgcagagcttcaattcgtttatccagcggcgggtgggtcatgaacaactcactgagcgatttcgacttaccgttaatgcagagagccatcatgctggttgcttcttgcggttcatagctggttttcaggcgctgcagcgcggcaatcattttctcgcgaccaaccagttttgccgaaccggcatcagcatggaattcacgatgacgcgagaaccacatggtgataatgctcgccagaataccaaacaccagttccagaaccgttgcaaccgcaaagtagatcagcgggttgccgttgctctcttcaccttcatcacgatttccgcccataaaacccgcggcaagctgcgccagaatacgggaaataaagataacgaaggtgttcaccacgccctgaatcagcgtcatggtgaccatatcaccattggcgatgtggctgatttcgtgagcaattaccgcctcggcttcatccgggctcatgttctgcagcaaaccggtgctgacagcaaccagagaggcatcacggcgcgcaccggttgcaaaagcgttgatgtccggcgcatggtagatagccacttgcggcatagcgatccccgcctgacgagcctgggttgctacagtattgaccagccaacgttccctttcgttacgcggttgctcgatcacttccccgccaacagatcgtaatgccatccatttggacatcagaagcgaaacgaaggaaccaccaaaaccgaacagcaaggccatgatcatcagcccctgaacgctgctcgactgtatccctgtcaggctcagtaccagcccgaaaacgaccattacggccaggttcgttagcaggaagagcgcgattcgcatcataattttctttttacctcagtttaacaaaacgcaatatgcgatacccacatcgtatgggttacgcgactattttcaagtctggatagtgcgtaagtcaccagaaagacacaactttacattttgtagcatctgatttacggcatcttgtcgctgttaaaaaatcaggcacaatttcttgtgcctgattgatattacttgacgggagcgggttgttccgcgggtctggctttttcaagcttcgccagatcgagtgcgatattcaccgtctcatccagataaggatccggctcctggtaatctttcggtagatcatccagtttcttcaactccggtttaccttcgcgtttaaagcgttcgttcaaacgcgccagacgcgtcgcatcatcttcattattctctttctcacgcacagcgtaattcagagaaacgatattgcgcttgtccttcatagcgttgaagcgcgcgatatccttcatgatgttctggaactcaggatctttcgcgatacgcgcattatgttccttcagcagctccggttcaaaggccgttaaatctcctgatttcacataagtcgcggcatcaatgctatcccacggcagcgcgttatcttcgaatttctcacccgtttccgtttcttcattacccgtcggcatgatgatgtctggcgttacgcctttacgttgcgtactgccgccgttaacgcgatagaatttctggatcgtgtactgcacagaacccagcgctggccattcaggacgtaacatctgatcgtaaatacggttcaatgaacggtattgctgaacggtgcctttaccaaacgtcggttcacccacaaccagcgcacgaccgtaatcctgcattgccgcggcaaagatttctgaagccgaagcactgaagcggtcaaccagcaccaccagcgggcctttatagaaaacctgtccgtcggtatcgctatcttcacgaaccttgccgttgttatcgcggacctgaacaatgggacccgcaggaataaacagaccggagagcgatacggcttcagttaacgccccaccgccattgctacgcaggtcgatgatgacgctgctgacattctgtttttccagtttctgcagttgcactttgacatcgtctgtcaaacccacatagaagcccggaatatccagcacgccgactttctctttaccgacggtcttcaccgacattttaaccgcgcggtcttcgagacgaatacgttcacgggtcaacgttacagtacgggtcttggtccctttaccagcaggtaaaatttccagacgaactttactgcccttcggccctttaattaaggcaaccacatcatcaagacgccagccaatcacgtcaaccatcggcttgcctgtttgaccaacaccgacaattttgtcaccaacgctgatagctttactcttcgctgccggaccacctgccaccatcgaattgataacggtgtagtcatcatccatttgcagcactgcgccaataccttccagcgacaaactcatttcagtgttgaactgttcggtattacgcggggaaagatagttggtatgcgggtcgatttcacgcgcaaacgccgtcattgccagcgagaaaacatcttcgctgttggtttgcgccagacgacgaatggcaaatttgtagcggcgagtcagggtttcacgaatttctttatccgtttttcctgtcagcttcaggcttaactcgtcgaatttgactttactgtcccacagcgcgttcaactcagcctcgtttttcggccagggcgctttgctgcggtcaaggttataagtgtcgttgccggtgaaatccatcggcttttccagtaccgacaaagcgtactggtaacgctcaaaacggcgcttttgcgccagattgtagagatcgtagaaaacgtcgagtttgcctgaacgcagttcatcgcctaactcggttttctttttcgcgaactgttcaacatcgcttgccagcagcacgttgtggctgtaatcgagcagattcaggtagcggtcaaagattttggccgaaaatgcctgatcgaggtcgaactggcgataatgagaacgggtgaagcgcgacgttacgcgctcacttaccgtcgcatgctgcgtctcttcctttaataccggaatttgatcagcacgcgtgatatcttctacagcgaaggtctggcctgctattgcaagcaggccagctaacgcggtaagcctaaaaaacatgttcatgcctggcccggcctccgtttcagaacaccaggtgttctgcgcgcacaatcaaagacatacccgaattcagctggacgcggacgccgtctttggtgatttctaatacggtggcatccatcgcgttttgacccgctttcaccttcagggcttgtccgacagtcagagctgaaatgtcagaaaccggggtgtgctgttcttcgcgaggtgcttttactgtttttggcgctttctctaccggcttttgcgcacgaggtttacgttcagcgccttctttgcggcgtggcgtagtcggacgtggcttgcgttcgcggcgcggtgcgtcttctttctcaccagcagttgcggcagcttcgcgttttttcgcttgctgttcagcacgctgtgcctgaacacgcgctttcgcttcttcaagctgcttgcgagcatgctctacatgttgctcgtccagctcaccgcatgggttgccgtcaagatcgacacgcgttgcgccgggtttaacaccgtaaagataacgccagctcgaagtgtagagacgtaaagcggatcgcaattgcgttttgctcaggttcatttccccagcaacacgatcgaccaaatcctgaaaaataccgattttcagcggacgcgcttcaccttccgcactgaaacagtggggaaaacgttcggccagaaacgcgattacttctttactgctattcaacttaggttgattttccatgaaatttcctgattacaacggacgtagccaacaagcgcaggcatgaacaggcgtcattataatgacgctatcagtaaatgctacgttatccgttgattatcctgcgacgctcgcaaagaattttttgtaatccgtcgttgcaagcactttttcaagctgtgccacaagctgacgtaagccttgctcgtcctcgtctgtaaagcgaccgaagacggtactatcgatgtcgagaacaccaataatctgatttttcaccaccagcggcagaacaatttcagaattactcgccgcatcacaggcaatatgcccgtcaaacacatgaacatcctcgatacgctgcacttgattgcgggcaaccgcagtgccgcacacgccgcgcccgacgggtatccggacacaggcaattttgccctgaaatggtccgagtaccagtgtatcgtcctcaagcaaataaaaacctgcccagtttatgtcagtgagacgctcatataacaacgcactggtgttcgcaagcgttgccagaaaactggtttctcccgccatcagcgcgttaaagtcgcgatttaaatccgcgtaaaattctgttttgttcattatataatcacttggttgtcttacctggatctgccagcctattaaaataagcattaaatgcgttaatgctcaagatcattcccatcatgggttaagattaatgttaattcttattacatttggcacgtcatggctcttaacacaccacaaattacgccgacaaaaaagataacagtgagggcaatcggcgaggaactgccgcgtggtgattaccaacgttgcccgcaatgtgacatgctgtttagcctgcccgagataaattctcatcaaagtgcctattgtccgcgctgtcaggcaaaaattcgtgacgggcgcgactggtcgctaacgcgcctggcggcaatggccttcaccatgctgttgcttatgccgtttgcctggggcgaaccgctgttgcatatctggctgttaggcattcgtattgacgccaacgttatgcaaggcatctggcaaatgaccaaacagggcgatgcgataacggggtcgatggtctttttctgcgttattggtgccccgctcattctggtgacctccatagcttatttatggtttggtaaccgactgggaatgaatttacgtccggtactgctgatgcttgagcgacttaaagagtgggtaatgctcgatatctacctggtcggcattggcgttgcttctataaaggtacaggattatgcccatatccaggctggtgtcggcttgttctcttttgtggcgttggtgattttaacgacggtgacgttgtcacatcttaatgtcgaagaactgtgggagcgattttatccgcagcgccccgctacgcgtagggacgagaaacttcgtgtctgtcttgggtgccattttaccggctatccagatcagcgtggtcgctgcccgcgttgccatatcccgctacgcctgcgtcgccgtcatagtctgcaaaaatgctgggcggcgctgttagcgtcaatcgttttattgttacctgccaacctgttgcctatttctatcatttatctgaacggaggacggcaggaagatacaattctttccggaattatgtcgctggcaagtagcaacattgcggttgcaggaatcgtgtttatcgccagtattctggtaccgtttactaaagtgatcgtcatgttcactttactgttgagcattcattttaaatgccagcaaggtttacgcacacgcattctgttactgcggatggtgacctggattggtcgctggtcgatgctcgacctgtttgtcatatctttaaccatgtcgctgattaatcgcgatcagatcctcgcttttactatgggaccggctgcgttttatttcggcgcagcggtaattttgactattcttgctgtggaatggctggacagccgcttactttgggatgcacatgagtcaggaaacgcccgcttcgacgactgaagcgcagattaaaaataaacgccgtatctcacctttctggctgctgccgttcatcgcgctaatgattgccagttggctgatttgggacagttatcaggaccggggtaataccgtcaccatcgactttatgtcggcggatggtattgttccaggccgtacgcctgttcgttatcagggcgttgaagtcggaacagtgcaggatatcagcctcagcgacgatcttcgtaagattgaagtcaaggtcagcatcaagtccgatatgaaagatgcgctgcgcgaagagactcagttctggctggtgacgccaaaagcatcgttggcaggtgtctccgggctggacgccctcgtcggtgggaactatatcggcatgatgccgggtaaaggtaaagagcaggatcactttgtcgcactcgatacccaaccgaaatatcggctggacaatggcgatctgatgatccacctgcaagcccccgatctcggttcgctgaacagcggttcattggtctatttccgcaagatcccggtgggaaaagtctacgactatgccatcaatcccaacaagcaaggcgtggtgattgatgtcctgatcgagcggcgttttaccgatctggtgaaaaaaggtagccgtttctggaacgtttccggcgttgatgccaacgtcagtatcagtggcgcgaaggtgaaactggaaagcctggcggcactggttaacggtgcgattgccttcgattcaccagaagagtcgaaacctgccgaggcggaagatacctttggtctgtatgaagatctggcccacagccagcgtggcgtaataataaaactggaactgccgagtggggccggattaaccgccgactcgacgccgttaatgtatcaggggctggaagtcggacagctgactaaactggatttaaatcctggtggtaaagtcacaggggaaatgaccgttgatcccagcgtcgttaccctgcttcgtgaaaatacccgcatcgaattacgcaacccgaaattatcccttagcgatgctaatctcagcgccctgctgaccggcaaaaccttcgagctggtgcccggcgatggcgagccacgcaaagagttcgttgttgtgccaggcgaaaaagcactgctgcatgaacctgatgttctgacgctgaccctgaccgcgccggaaagttacggtattgatgcgggtcagccgctcattcttcacggcgtgcaggtaggccaggttatcgatcgtaaactcaccagcaaaggcgtcacctttaccgtcgccatcgagcctcagcatcgcgaactggtaaaaggcgatagcaaatttgtcgtcaacagccgtgtcgatgtgaaggtggggctggatggcgttgagtttctcggtgccagcgcctcagaatggatcaatggcgggatacgtattctgccgggcgataaaggtgagatgaaagccagctatccactgtatgccaatttggaaaaagcgctggagaacagccttagcgatttacccaccacaaccgtgagtttgagtgcagagacgctgccggatgtgcaggcaggatcggtagtgctgtaccgtaaatttgaagttggtgaagtgattaccgtgcgtccgcgagctaacgcgtttgatatcgatctgcatattaagccggagtatcgcaaccttctgaccagcaatagcgtgttctgggcagaaggcggggcgaaagttcagctgaatggtagtggtctgaccgtacaggcatccccgctctccagagcattaaagggagccattagcttcgacaacctcagcggtgccagcgccagtcagcgtaaaggcgataagcgtattctgtatgcttccgaaacagcggcccgtgcggttggcgggcagattacgcttcacgctttcgatgccggaaaactggcggtcgggatgccaattcgctatctcggtattgatatcgggcaaatccagacgctggatctgattaccgcacgcaatgaagtacaggcaaaggcggtactttacccggaatatgtccagacctttgctcgcggtggtacgcgcttctcagtggtcacaccgcaaatttcggcagctggcgttgagcatcttgatactatcctccagccgtatatcaacgtcgaaccaggccggggcaatcctcgccgcgactttgaattacaagaggccaccattactgattcgcgttacctggatggcttaagcattattgttgaagcgccggaagccggttcgttaggcatcggtacgcctgtgctgttccgtggtctggaagtcggtacggttacaggaatgacgctggggacattgtcagatcgcgtgatgattgcgatgcgcatcagtaaacgctatcaacacctggtgcgtaacaattccgtcttctggttggcatcgggttacagtctggactttggtctgacgggcggcgtagtgaaaaccggcacctttaaccagtttatccgtggcggcatcgccttcgccacgcctccgggtacgccactggcaccgaaagcccaggaaggcaaacacttcctgttgcaggaaagtgaaccgaaagagtggcgtgaatggggaactgcgcttcccaaataatgcccactgctccggcgtgcctgcgccggagcgtttatgctaaactgcgcgcctgtttttttgccagtggtacatgctcgtggcccaacacaccgtttatttcccggacgcctttctgacacaaatgcgcgaagcgatgccttcgacgctctcatttgatgattttcttgccgcctgtcagcgcccgttgcgccgcagcattcgcgttaatacgctgaaaatctccgttgctgatttcctgcaattaaccgctccttatggctggacgcttacgccaattccgtggtgtgaagaaggtttctggattgaacgcgacaatgaagatgcattgccattgggtagtaccgccgagcatttaagtggcctgttttatattcaggaagccagttcaatgttgcctgttgccgccttgtttgctgacggtaatgcaccacagcgggtgatggatgtcgctgccgcgcctggctccaaaacgacgcaaatttccgcgcggatgaataacgaaggggcaatccttgccaatgagttttccgccagtcgggtaaaagtgttacatgccaatatcagccgctgtggtatcagtaatgttgcgctcacacattttgatggccgcgtgtttggtgcggcagtgccagaaatgttcgatgccattttgctggacgctccctgctctggcgaaggcgtggtgcgtaaagatcccgatgcgctaaaaaactggtcaccagaaagcaatcaggaaatcgcagctacacaacgggagcttatcgacagcgcctttcatgcattacgtcctggtggtacgctggtttactcgacctgtaccttaaaccaggaagaaaacgaagccgtttgcctgtggctgaaagagacttaccccgacgcagtagagtttttaccacttggcgatctcttccctggtgcaaacaaagcgctgaccgaagaaggctttttgcatgttttcccacaaatttacgactgcgaaggcttcttcgttgctcgtctgcgtaaaactcaggcgattcccgccttacccgcccccaaatacaaagtcggtaattttccgttcagcccggtgaaagatcgcgaagctggacaaattcgtcaggcggctacaggtgttggcttaaactgggatgaaaacctgcgcctctggcagcgtgacaaagaactgtggttgttcccggtgggcattgaagccctgatcggtaaagtccgattttctcggttggggattaaacttgccgagacgcacaacaaaggttatcgctggcagcatgaagcggttattgctcttgcctcacccgataatatgaatgcattcgagctgacaccgcaggaagcggaggagtggtatcgcgggcgcgatgtttacccgcaagccgcgccagtggcggatgatgtattggttactttccagcatcaaccgattggtttagccaaacggattggttcgcgattgaaaaacagctatccgcgtgaactggtgcgcgatgggaaactttttaccggtaacgcctgacagcgcacaaaaaaagcgcactttttgactggcacattcggctgcctcaactaggctgaaaaatggtgcgatcggactggtcgtaccacaatcggcagctaaatggagagcacgaagatgaaaaccagtgtgcgcataggcgcttttgaaatcgacgacggcgaattacacggtgaatcgccaggtgatcgaacgttaaccattccttgtaaatctgaccccgatttatgtatgcaactggatgcctgggatgctgaaaccagtatccctgccctgctaaatggcgaacactctgtcctttaccgtacccgttacgatcaacaatctgatgcctggattatgcgtcttgcctgatccaaaaagaacccgtcggcatggcgggttatttgtcctggttattcccccgttgtaaaatctctcctaaacttaacggtacggcaccacacttcggggatgaaatgttcgcgctggtactttttgtttgctacctggatggcggttgtgaagatattgttgtggatgtctacaacacggaacagcagtgtctttattctatgagcgatcaacggatccgccagggcggttgttttccgattgaggattttatagatggtttctggcgacctgcacaggagtacggtgatttttaattattgcaattgcacaagagtcagttcgcccccaaagacagcaccggtatcaatataatgcaggttgccaatatccacgcgatgtcgcaacggtgtatgaccaaaccagaaatgatcagcacctgtaattccctgccctttttggcgttcacctaatcgcgagcggctccacaagacctgatgcaaatcaacgtccttttgccattcataaacatcatctggataatcggcatgagcaataacatgcttgccggtgcgactgtgtacttcaagaataaagggcaaatgctgacatttttccagcgccgttttcgcttgtttctgttgattatctgccagcgcaataaaccagtcgccgccattcatcaaccacaaagacatctgctgggatgccagcgcatccatcgccatctgttcatgattgcctcttaccgcacaaacccaatgttgttccagtaactgcagacaacgtaaactttgcggcccacgatcgataacgtctcccactgagataagtaaatctcgccacggatcaaaacgacaatgccataatttgcggcgcaactgctcaagacaaccgtgtatatcgccagaaagccagatatgtcgccattgatgacccgcaattctctgataaacgggcgcaggctgtttcatcaatattttcctcccgcgctaaagatcacataatcttaacaagaatgttaaaaaacgctggactcagacagtagagtgtgtgttatggttgactataaagtcagcgaaggaaatgcttctggcttttaacagataaaaagagaccgaacacgattcctgtattcggtccagggaaatggctcttgggagagagccgtgcgctaaaagttggcattaatgcaggcttagttgccttgccctttaagaatagatgacgacgccaggttttccagtttgcgtgcaaaatggtcaataaaaagcgtggtggtcatcagctgaaatgttaaaaaccgcccgttctggtgaaagaactgaggcggtttttttattggaaatcaaaaggctattttaggtaattaacagagtttttcagctcgttctataaacggtgccagactcattttttcgccgggattgttaggatcatcaatctgaatcaccgaaatgggttgggcattggtcttcccactggcaacttccttttgtgcgatatcgtttaaaggatactgcacgagggtactcggattaataacatacaaagcattacccggtcggcaagtcagcatcacctcttcgcgattaaacgcccatttgtctttacccacttcaaaacgactgacggtaatcacctgcggtgcagccagcgccgctgcagaactggtgagtaacagaaacgccagaatactttttttcatcattttcgtaatccatcaaaaaggttcgagagtcgcaagcaggctgatgatcaccagcactaccgcacctatcgcccattcgagtttagtcatccacacaaaccagggtgccgcacgatcttcatcctgcctcatgcgcggtacaagaacataacgattagccagcgcaatgaccaccataatcatcaccaggatggctttgagcaataagagttggccccagtaagtcgtaagcgtggggggaaatccggtaatcaacaatgcattaagcacgccgcttgccagtacgccgatcaccgcaaaatgcccgcaccaggaaaaacgcatcagcgcctgaatagcctggtgtcgccaacggcctttgatgagttgcatacaccagagcaccggcagtaatcccccaaaccacgccgccgcacaaatcaggtgaatcgcgtgattagtctgatggattttcgctgttaccccttcattcagcgtcgcatgccccactcccgccagcagaataaattgcgcggtagtgagcataaacagcaaacgtggcatattccgcggttgcataagggcgacgatcaacgttacgagggcgagaacaatttgccataaccagatgccaccaaactgcgtttgcaaaacagcctgccaaatgtttggcgaaaatacatctgtccatcccgttcccatcaacccgccctgaacggcgagcattgcagtggcactgatcaaactccagacggcagcgtgctgttgtaaacgcagaaaacgcttcgccagcaagcgacgaatcgtcaagggggccagccaggcaccgtacattgcgaagccaaaaaccagcatcagcgaggtgaaatggataaatcgcagcgcgatccaggtaaacgccagcatgatttatttcacgctaaaggtgtagtgtcctttcgttttatgcccgtccaccgaaacaacatgccagtcaacggtgtaggttccgggtttcagcgaatcggccagtggaacaatcagttgcttttggtcctgctcatttcgcttcgccggtaatgttttaatattttcgttttttggccccgtgatttttgcaccactgaatcctgtttcaacaccttccgagaagtttaaagtgattgcctgcggtgcagctgtcacttgcgcgtttgccgcaggatactgatgcgttaaatgcgcatgtgcccagacggaaggtgtcaccaacgaagtggtcaggattgccagcgcgtagcgaagggagcgtgcagttgaagccatattatctattcctttttgtaataacttttttacagagcataaccttgtctaatgtctgagtcgaggatcatcaattccggcttgccatcctggctcactcttagtaacttttgcccgcgaatgatgaggagattaagaatgctgaagaatctggctaaactggatcaaacagaaatggataaagtgaatgtcgatttggcggcggccggggtggcatttaaagaacgctacaatatgccggtgatcgctgaagcggttgaacgtgaacagcctgaacatttgcgcagctggtttcgcgagcggcttattgcccaccgtttggcttcggtcaatctgtcacgtttaccttacgagcccaaacttaaataaaacttatacagagttacactttcttacataacgcctgctaaattatgagtattttctaaaccgcactcataatttgcagtcattttgaaaaggaagtcattatgtcgttctggaaagttgcagcagcgcaatatgagcctcgtaaaacctcactcaccgaacaggtagctcatcatctggagtttgtgagggccgccgccaggcaacaatgtcagctgttagtttttccatcgctttctttactggggtgtgattattcgcgacgtgcccttcctgccccacccgatctctcactgttagacccgctttgttatgccgcaacgacctggcgaatgaccatcattgccggccttcccgttgaatataacgatcgctttattcgtggaattgcggtgttcgcaccgtggcgaaaaacgcctgggatctaccatcagagtcatggtgcatgtctgggccgtcgttccagaaccatcacggtggtcgatgaacaaccgcaaggtatggatatggacccgacctgttcactgtttactacagggcaatgtctgggagaacccgacctgctggcgtcggcccgtcgcttacaatttttttcacatcagtactcgattgccgtgctgatggcaaatgcccgtggtaacagtgcactatgggatgaatatggtcgtctcatcgttcgcgccgatcgtggttcattattgttagtcggtcagcgttcatcacagggttggcaaggcgatatcattccattacgctaggctttttcggcctggagcatgccatgttgcgcattatcgatacagaaacctgcggtttgcagggagggatcgttgagattgcctctgttgatgtcattgacggaaaaatcgtcaaccccatgagccacctggtgcgccccgatcgtcctattagtccacaagcgatggcgattcatcgcatcaccgaagccatggtcgccgataaaccgtggattgaagatgtgatcccacactattacggtagtgaatggtatgtcgcgcataacgccagctttgaccgccgcgtactgcctgagatgcccggtgagtggatttgcactatgaaactggcccgtcgtttgtggcctgggatcaagtacagcaatatggcgttatataaaacacgcaagctcaatgtacagacgccgccgggcctgcatcatcaccgcgcgttgtatgactgttatatcaccgccgcgttgcttatcgatattatgaacacctccggctggacggcagaacagatggccgatatcaccggacgtccgtcgttgatgacgaccttcacctttggcaaataccgtggcaaagcggtttccgacgttgccgaacgcgatccgggctatctgcgctggttatttaataacctggacagcatgagcccggagctgcgtttaacactgaaacattatctggaaaatacttagtccgcaggcgtagcgggtaatgttccctgcgccagcgcgaccagaaaagcatattccatcgctacgccttcgtacgatttaaagcgaccagatttaccgccatggcctgagtccatgtcggtacagagcaataaaagatggtcatcggttttcagctcgcgcaatttagcgacccattttgccggttcccaatattgcacctgagaatcgtgcaaaccggtcgttaccagtaaatgcggataagcctgtgcggtgacgttgtcatacgggctgtagcttttcatgtactcgtaatattgcggatcctgcgggttaccccactcttcaaactcaccagtggtaagaggaattgattcatcaagcatcgttgttacaacatcaacaaacggtacctgggcgataacgccgtggaataattccgggcgttgattaattgcaacgcccatcaacatgccccccgcactcccgcccatcgcataacaaagcgaaggagagccatagcccagttttaacaatgcatcgcaggcatcaagataatcattaaacgtatttttcttcttcagaaattttccgtcttcgtaccattgttgccccagctcaccaccgccgcgaacatggacaatggcgtagacaaagccacgatctaacaaactcaagcggctaaaactgaaatcggcatcaatacttgcgccgtaagaaccatagccatacaccagcaacgggttgtgtcctttgcgaaaatgtttgcgatggtagaccaacgaaaccggaacttcgacgccatcacgggcgactatccacaggtgttcactgcggtaattcgccgcataaaaaccaggaacttccgtttgttttaatacacgacgctcaccggtatccatatccagttcaaacaaagtgtctggtgtagtcatggaagaataaccataacgcaatcgcgcggtttcaggttctggattgtaggcaatccaggtcacataggccggatcatcaaaggcaataccaatgacttcccgggtcttgcggttaatttggcgcaaactggttaacccgcgctgacgctcttcaaccaccagccagtcggtaaacagcgtaaacccttccagcatgatgttttcgcgtggcggaattaactcttcccactgttgctcatcacgcatacgggtacggtataagccaaagtttttgccgtggcggttggaacgcagataaaaacgatgctggtagtgatcaaggctgtattcgtgatctttgcggcgcggcagaaaaacaaacggctcggcatcggccatttccgcgtccagcaggcgaacttcactggtggtggcgctggccaaatgaatgactacatagtgcttcgaggtcgttttatgcaggctgacgtaataggtatcgtctttttcttcgtagatcagtttatcttgcgatgctggcgtaccgatggcgtgacgccagacctgataaggcagcagcgtcaccggatgcttgcgaacatagtagaaaatccaggagtcatttgcccagacaaagctgggttcaacgttatccagcagttccgggtaccagttaccagtttccagattacgaaaacgaatgccgtactggcgtcgggaaagaaaatcttctgccagcgccataatggtgttatcgggcgtaatcgccattccgcccatcgaataaaactcactatgagctgcgcgcttattggcatcgagcaatgtttcccactcatcccactcttcactgaatgccgattgacgctggtagatagcatattcacagcctggttcataaatatgccgatagcggtagccatttttgatgtagggcgcagaaacttctcgttgcggaatgcggtcgatgatttcctttaagatgcgatcctgcaaggcttgttgtgaggccatcacccgatgaccgtaactattttcttgttgcaggtagtccaggacttctggctgagaacgcgtatcgtcccgcagccagtagtaattatcgatgcgcgtatcgccatgaagcgtcatggcgtggggaatgcgggcggcttttggtagcatgttattgttctttctggttgaaacatcttataagggtggcaaaactcaccggggatgcaagcgaaacaggggagtcattgcttagatgatgacaggtaatggcgcggatatcgaatgttatgcagacagagaaaatcagcctgttcaaatggctgtgcgattctggatagcccgaaatagtcaacttcaggctatccagagagcggaattattccgccaaagtgcgtttttgctgttcgagatcgcgttcaatgccgtcacgaacatcctgggggattttcagcgcgtcacccagtgcattcaggtaactgcgttccataaaatggtcaatatcaatagccgcgcaactcaggaaatagatttccagcgcctcttcttcattgcggaccccggtagccaggcgttgtggatccagcggttgttcgattgcctgctcaatgagtacacgcccctgctcttccacgccggctccacgcaattgctggtcgattgccgcacgttctttggcatcaatatgaccatcacttttagcggcaaagaccagcgcaaggatcaaacgtgctgtacgctcatccagcggcgtactttgcgcgccaaactgcggttcgtcctgatgcgccgcgcgaattttatctttgtatttattccacagcaccgtacccgctaccgctccgccgccaaccagtaacgcgttggtgccatatttcgtaagaagtttacgtgctgatttatttgcgaccagcagcccagccagtccgcctaatgcgcctggcactaacagtttgaccaatccctgatccgcagacgaggaggtagaagaactgctttgcccaagcagggattgcagttgatttaaccagttagccatatttgctcctcaataaccatttttagtgcctgtagcatagcggatgaggatgtcagaaaatgtatatcgagacaaaagatgcgcaaataagcggggcggtaggccgttattcaaagaaattcgcgccaggtaaggtatttactgtatatcaggtgataagggtattttaggtgaaagtagtttgtcgttttgagtggcattgtttgatgctgattgcccgatgcgacgctgttgcgtcttctcaggcctacgattgtggtgcgttctggggcggacaaggcactcgcgccgcatccgccaacagtcaatcgaattatcagaagccattaacgccgctgatattccgccattcccgctttgcagtccacgctgacctggtaatgaatatcggcacttttaccacgcacggttagcggtactgaccatttatcatctttaccctgaatgtcctgcaaactgacccaagccacgggatcggcctgaccgacaattttttgatcatctgcccaacgcgccacgcgattttgttgataatcacgttttacgctcgcggcaattccggcagcatccagatcttcacactttgggaaagtgaccgacttgctggtttcattattggcagcgaaaactgatgcgcaggcagaaaccaacaacagccctaaaaacgcccctctttttttcatgtttttctccatagcacaatgattcaggagaaagcatggtacaaattgtcaggagcgcaagttgcttcaggccgcgtgtgaggcatcttcctcttcggattcagcaccgacgacctgtggggacggtaatttgccggttttcagaatggtgctcagcacatctttttgttctgccagccatagcgaaagggcttcacgttgctcgtcttccatttgcactggagaatttgtcagccaggtgtcaagcagatccgccgtatcaagcattttgtcataagcatcggcttcctttttgctggtaaacgacattttctcttcgccctcacgaatgactacgtatttaacttcaaccgccatttgcagcctctcataataactgtgattttatacagtatatttcttttcggttgagaaatcaacatcagcaataaagacacacgcaaacgttttcgtttatactgcgcgcggaattaatcaggggatattcgttatgacgttattaggcactgcgctgcgtccggcagcaactcgcgtgatgttattaggctccggtgaactgggtaaagaagtggcaatcgagtgtcagcgtctcggcgtagaggtgattgccgtcgatcgctatgccgacgcaccagccatgcatgtcgcgcatcgctcccatgtcattaatatgcttgatggtgatgcattacgccgtgtggttgaactggaaaaaccacattatatcgtgccggagatcgaagctattgccaccgatatgctgatccaacttgaagaggaaggactgaatgttgtcccctgcgctcgcgcaacgaaattaacgatgaatcgcgagggtatccgtcgcctggcggcagaagagctgcagctgcccacttccacttatcgttttgccgatagcgaaagccttttccgcgaggcggttgctgacattggctatccctgcattgtaaaaccggtgatgagctcttccggcaaggggcagacgtttattcgttctgcagagcaacttgctcaggcatggaagtacgctcagcaaggcggtcgcgccggagcgggccgcgtaattgttgaaggcgtcgttaagtttgacttcgaaattaccctgctaaccgtcagcgcggtggatggcgtccatttctgtgcaccagtaggtcatcgccaggaagatggcgactaccgtgaatcctggcaaccacagcaaatgagcccgcttgcccttgaacgtgcgcaggagattgcccgtaaagtggtgctggcactgggcggttatgggttgtttggtgtcgagctatttgtctgtggtgatgaggtgattttcagtgaggtctcccctcgtccacatgataccgggatggtgacgttaatttctcaagatctctcagagtttgccctgcatgtacgtgccttcctcggacttccggttggcgggatccgtcagtatggtcctgcagcttctgccgttattctgccacaactgaccagtcagaatgtcacgtttgataatgtgcagaatgccgtaggcgcagatttgcagattcgtttatttggtaagccggaaattgatggcagccgtcgtctgggggtggcactggctactgcagagagtgttgttgacgccattgaacgcgcgaagcacgccgccggacaggtaaaagtacagggttaaacccggcaaaaaaacgctacaaaaatgcccgatcctcgatcgggcattttgacttttacagcttagcgccttctacagcttcacgcgccagcttagtaatgcggtcgtaatcgcccgcttccagcgcatctgccggaaccagccaggaaccaccgatgcacagcacgcttttcagcgccaggtagtcacggtagttagccggagaaataccacccgtcgggcagaaacggacctgggagaacggacccgcgatcgcctgcagggctttcacgccgccgttagcttcagccgggaagaatttgaactctttcaaaccgtagtccatacccagcatcagttcggaaacagtgctgatccccggaatcagaggaatagtcccttcggtagcagctttcagcagcggctcggtcagacccgggctaattgcgaactgtgcacccgcttcagtgacttctgccagctgctgtggattcagcaccgtaccggcacccacaatcgcttcaggcacttctttggcgatagcacggatagcgtcaactgcacactcggtacgcagagtcacttccagaacgcgcaccccaccagcaaccaacgcttttgccatcggcaccgcgtgttccagtttttttaccacgataaccggtacaaccgggccggtggtcaggattgattctgcacttgttttccagtttttcatcagagttttctctcgcctgattacaaatttgtcgtcttaaaaagtgatacaggttgcgccctgttcggcaccggacagtttttcacgcaaggcgctgaataattcacgtcctgttcccacgcgtgacgcgctcaggtcaggaatgtgcggttcgcgagcagccagttccgcttcgtctaccagcagcgtcagttcgcctgtctgtccattcacacgaatgatgtccccgtcgcgcacttttgccagcagcccgccatcgtaggcttctggtgttacgtggatagctgacggcactttacctgaagcgccggagagtcgtccatcggtaactaacgcaattttgaaacaccggtccaataatacaccaagtggcggcatgagtttatgtaattctggcattccgttcgcttttggcccctgatgacggacaacaacgacacaatcgcggtccagcaaacccgcttcaaaggccggcataacgtcatgctggctttcaaaaacaaccgctggcgcttcaatcacctggttctcaaccggcacggcagaggttttcataaccgcacggcccaggttaccgcttaacacttttgtcccaccatgatgagagaaaggttgttcgaaggaagcgatcacattgctgtcgagtgatttttccgccccttcccgccagtccagttcaccattattcagccatggttcaagggtataacgagacagaccaaaacctgccaccgtattgacatcttcatgcagcaggcctgctttgagcagttcacgcaccagaaccggtacgccacctgccgcctggaagtggttaatatcggccggaccgttcgggtagagacgtgccatcagcggtacaacatcagaaaggtcagagaagtcatcccagttaatctgaataccggccgcgcgcgccatcgccaccaggtgcatggtgtggttagtggaaccaccggtcgccagcagtgcaacgataccgttcaccaccactttctcatcgatcatcttaccgatcggcatccattcattaccattaccggtcatgcgtgtaacctgacgcgcagctgcggcggtcaaagcatcgcgcagcggagaatccggatgaacaaaagaagagcctggcaactgcatccccataaactccaccaccatctggttggtgttggcagtaccgtagaaagtacatgttcccggcgcatggtaagacgcggcttctgactccagtaaggccatgcggtccactttaccttcggcataaagctggcgaatacgcactttttctttatttggcaaaccgcttgccatcggtccagacggcacaaacaccgcaggcaaatgaccaaacgacagggctgccatcgtcagacccgggacaatcttgtcgcacacaccgaggaacagagcaccatcaaacatgttatgggacagccccaccgccgcagacatcgctatcacttcgcggcttagcagcgacaattccattccatcctgcccctgggtgacaccatcacacatcgccggaacaccgcccgcaacctgaccaaccgcattcgcttcatgcagggctttacgaatgatttctggatagtgttcataaggctggtgcgcggagagcatgtcgttataggaggtgatgatggcgatattgttacgcaacatgcttttcaaagaggctttgtcttctggctggcaggcagcgaaaccgtgtgccaggttaccgcatgccaactgcgaacgatgaacggtcgaagttttcgcttgttctatccgggcgagataagcagagcgagtctcgcgcgaacgttcaatgattcgatttgttacgcgtaacaattgtggattcataaaggctcctgaaattgagttgtcagagcaggatgattcacaacgcgtttcattcagaggatttatgactgaaacgcctgtaaccggagctcatagggcaaaaacgtttcagtcagtgtaataaaaaaagcctcgtgggtgaatccgcacgaggcctgaaagtgtaaaaattgttctacaatctgcgcaagatcatgttaccggtaaaataaccataaaggataagcgcagatattactcaaactcattccaggaacgaccatcacgggtaatcatcgccaccgaggcaacgggtccccaggttccggcctgatacggtttcggcgcatcattgtccatcgcccacgcctcagtaatggagtctacccatttccaggcttcttccacttcgtcgcgacgtacaaacagtgcctgaataccacgcatggtttccagcagcaaacgttcataggcatccgccagatgcgtctgattaaaggtttctgaatagctcagatccagcttggtgatttgcaggttatgtttgtggtcaaggccaggaactttattcagtacctggatatccacgccttcatcaggttgcagacggatagtcagtttattctgcggcagatcctgccacgattctttaaacagattcagttcaggtgttttgaaatagaccacgacttcagaacatttggtcggcagacgtttaccagtacgcaggtagaatggcacaccggcccagcgccagttatcaatgtcgacgcggatcgccacgaaagtttctgtattgctgctcttgttcgcgccctcttcttccagatatcccggcacttttttgccctgggcgaagcccgcagtatattgcccgcgtacggttttttcgcgtacgttggagcggtcgatgcggcgcagagacttcagtactttcactttttcatcgcggatgctgtctgcgctcaggtcagacggcggagacatcgcaatcatgcaaagaatttgcagcaggtggttctggatcatgtcgcgcatctgaccggctttatcaaaatagccccagcgcccttcgatccccacttcttctgccacggtaatctcaacatgatcaatggtgcgattgtcccagttattcacaaacagggagttagcaaaacgcagcgccaacaggttcagcaccgtttctttaccaagatagtggtcgatacggtaaacctggcactcctcgaagtattcgccaacctgatcattgatttcctgcgaggtcgccagcgacgtccccagcggtttctccatgactacgcgtgccggtttagcattcagttttgcctcgccaagccctttgcaaattgcgccaaaagtgctgggcggcatggcaaagtagttaatggtgatacgatttttttgatccagcatcgcgccgagacggctgaatgcagcagtgtcattgacatcgagattacaaaaatccagacgtgcactcagggtgtcccataaaccttcatcaatggtttctttcatgaaagtttcgagcgcctcgcggacaactttggtatatgccgctttatcccagtcagcacgccctacgccgataatccgggtgtccgggttgagctgaccggctttttccagttgatacagggaaggcagcaatttacgacgcgcaaggtcgcctttcgcgccgaaaatgaccaggtcacaggcctgggctgtttgcgttaccgccatgtcattctccttaagttaactaacccggtacttaagccagggtatacttgtaattttcttacggtgcactgtactgcttttacgagcttgcgaaaactgtaaacgcttatccacccgtgcgattacgggaaaagcgcgcaaagtgcggcaaaactgataaaaaaatcatcgttttccattgggtaaaaatctgacactgatcatgttatgaaaaaaaataacaacttttttatctgcttttgtcattaacacggcacacaggcgtaatatctgacaaaactgcatttcgatttctttcagtgcggaaatcgtcattacccgtgagtctctttacatcatgaatatgctggaaaaaatccagtctcagctggaacatttgagcaaatcagagcgcaaagttgccgaggtcattctggcttcgcccgataacgcgatccattcgagtattgctgctatggcactggaagccaatgttagcgaaccgacggtgaatcgtttctgtcgcagcatggacacgcgcggttttcctgattttaaacttcatctggcacagagtctggcgaatggcactccctatgttaatcgcaatgtcaatgaagatgacagcgttgaatcatacacagggaaaatatttgagtccgcaatggcaacgcttgatcatgtccgtcattcactggataaatctgccatcaaccgcgccgtcgacttgctcactcaggcaaaaaaaatcgcctttttcggattaggctcttcagccgccgttgcccacgatgcgatgaataagttctttcgttttaatgttccggtggtgtactccgatgatatcgtgctgcaacgcatgagttgtatgaattgtagcgacggagacgtggtggtgctgatttctcacactggaagaacaaaaaatctggtcgagctggcgcagctggcacgcgaaaacgacgccatggtgattgccctcacctctgcgggtaccccgctcgcccgggaagcaacgctggcaattaccctcgacgtaccggaagatactgacatttatatgcccatggtttctcgacttgcacagctgaccgtgatagatgtgctggcgacaggatttactttgcgacgcggtgcaaaattcagagataacttgaagcgggtcaaagaagcgctgaaggaatcgcgttttgataagcagttacttaatttaagtgacgatcgctaaaaacgactgtcactgtcctaatcttatacgacatccgaatgagattaatttatcgccatcgcggcgttatttcattcggatttcatgttcaagcaacacctggttgtttcagtcaacggagtattacatgtccagaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaaccgttgcagccatggcgcgcgtttgcctgggtgcggaaaaaatcccgagcatcaacgtttctaaacaccgtctggacgttcagttcgacaatgtggaagaagctattgccatgtcagcaatgtacgcagctaaccacctgaaaggcgttacggcgatcatcaccatgaccgaatcgggtcgtaccgcgctgatgacctcccgtatcagctctggtctgccaattttcgccatgtcgcgccatgaacgtacgctgaacctgactgctctctatcgtggcgttacgccggtgcactttgatagcgctaatgacggcgtagcagctgccagcgaagcggttaatctgctgcgcgataaaggttacttgatgtctggtgacctggtgattgtcacccagggcgacgtgatgagtaccgtgggttctactaataccacgcgtattttaacggtagagtaagtacgttgccggatgcggcgaaaacgccacatccggcctacagttcaatgatagttcaacagatttcgaatattctgaagcaaacttgaacttatcatcaggcgaaggcctctcctcgcgagaggcttttttatttgatgggataaagatctttgcgcttatacggctggatttcgcccggtttgcgagttttcagcaattttagtatccaggtgtattgttctggtcgcggaccaacaaaaatctcgacttcttcattcatccgccgcgcaatcgtatgatcatccgcctctaacagatcatccatcggtgggcgcacctgaatcgtcagacgatgcgtcttgccatcataaatcggaaacagcggtacaacgcgcgcacggcacactttcatcaaacgaccaatcgcgggcaacgtcgctttataggtggcaaagaaatccacaaattcgctgtgctctgggccatgatcctgatcgggtaaataatatccccagtacccctgacgtaccgactggatgaatggtttaataccgtcatttctcgcatgcagacgaccgccaaagcgacgacgcaccgtgttccagacataatcaaaaaccgggttgccctgattatggaacatcgctgccattttctgcccttgcgaggccatcagcatggcaggaatatcgacggcccaaccgtgcggcaccagaaagataactttctcgttattacgccgcatctcttcgatgatctccagcccttgccagtcaacgcgcggctgaattttctccggcccgcgtattgccaactcagccatcattgccatcgcttgcggcgcggtggcaaacatctcatcaacaatcgcttcgcgttcagcttcactacgttctggaaagcagagcgacagattgattaacgcacgacggcgtgagctttttcccagtcgtccggcaaaacgtcccagccgtgccagaatgggatcacggaactttggcggcgttaaagcgatacccgccatcgctgctacgcccagccatgctccccagtagcgcgggtggcgaaaggatttatcaaactcaggaatgtattcgctattattttttttcgtttccatgcttttccagtttcggataaggcaaaaatcaatctggtgatagtgtagcggcgcaacttgccccgcaccaaataaaaaaagccggtactgactgcgtaccggctgcgaatggatgttaattaatcaaaccgtagctgcggcacaatctctttggcctgcgccaggaattcgcgacgatcggagccggtcagcccttcggtacgcggcagttttgccgtcagcgggtttacggcctgctggtttatccatacttcatagtgcagatgcggcccggttgaacgtccggtattaccggaaagcgcgatacggtcgccacgtttcaccttctgtcccggtttcaccagaatcttgcgcaagtgcatataacgcgtggtgtagctgcgaccatgacgaatagccacataataacctgctgcgccactgcgtttggcaaccaccacttcaccgtcacccactgaaagcactggcgtaccctgcggcatggcgaaatcaacacctctgtgtggtgcaacgcgaccggtcaccggattagtacgacgcgggttaaaattagacgagatacggaactgtttcgccgtcgggaatcgcaagaatcctttcgccagaccagtaccgttacgatcgtagaatttgccatcttcagcgcggatagcgtaataatctttaccttctgaacgcaaacgtacgcccagcagctggctttgctcacgtttaccatcaagcatttctcgagacattaacaccgcaaattcatcgccttttttcagtttgcggaaatccatttgccactgcatggctttaatcactgcgctcacttcggcgctggttaaaccggcgtttctggcgctggcaacaaagcttcccccgacggtacctttcagcagattgttaacccactctccttgctgcatttcgctggtcattttaaaaccgttagcggcagtacggtcataggttcgggtttcacgacgagacacttcccaggtgaggcgctgcagttcgccgtccgcggttaatgtccaggagagttgttgaccgattttcaggttacgcaattctttgtcggccgcagccagttgggtgatatcacccatatcaataccatactgattgagaatgctgcttagcgtatcgccagtggaaacaacatattcatgcacgcccgcttcaccggcgattttgtcatccagttcgtcctggggaatggcttcatcttcttgtgcagcttgatcaatcggctcactggcttcaggtaagagcgaacgaatttcgttctgttccagctcaatggttttgacaattggcgtggcatcacggtgataaacataaggccgccagacagcgacggccagagtaagaacggtgagcgaccccaacataacgcggtgtggtcgcggtaaattattaaacgccagggcgacagagcgggctatctgttgcacgtaatcacttcctcattaatctcctttcaggcagctcgcatactggttggctaattgactcaggaattctgaatagcttgttttacccagtttgatattcgtccccaggggatccaacgttcccatacgaacggatgtccctcgtgcgacgctctcaacgaccgctggcctgaactgtggctcagcaaaaacgcaggttgctttttgctcaaccaactgtgttcttatttcatgtaaacgctgcgcgccaggttgaatctcagggttaacggtaaaatgaccaagcggtgtcagtccaaactgtttttcgaaatagccgtaagcatcgtgaaaaacgaaataacctttccccttgagcggcgcgagctcgttaccaacctgcgtttcggttgaggctaattgtgcctcaaaatccttcaggttggcgtcaagtttggctcgactttgcggcataagttccactaattttccatggattgcaaccgctgtagcccgcgctatctctggggaaagccaaagatgcatgttgaaatcgccgtgatggtgatcttcgtcacttttttccgcgtggtcgtgatcatcatcatcgccgtgaatacttttcatcagtagcggtttcacatcttcaagctgcgcaatcgttacctgcttcgctcctggtaatttgcttaccggtttttgcataaacgcttccatctccgggccaacccaaacgactaagtccgcgttctgtaagcgttttacatccgatgggcgcagtgaataatcatgttctgaagcgccgtcaggaagtaaaacctctgtttctgttaccccatcagcaatggcagaagcgatgaacccaacgggtttaagcgaagcgacaacggcggcatctgcggcctgtgttgcacctccccagagagcggcggataatgctgcgaaaagaagcgtttttttatgtaacataatgcgaccaataatcgtaatgaatatgagaagtgtgatattataacatttcatgactactgcaagactaaaattaacatgacaagtctggtttccctggaaaatgtctcggtttcttttggccaacgccgcgtcctctctgatgtgtcgctggaacttaaacctggaaaaattttgactttacttgggccaaatggcgcaggtaagtcgacactggtacgggtagtgctcgggctggtaacacccgatgaaggggttatcaagcgcaacggaaaactgcgcatcggctatgtaccgcagaagctgtatctcgacaccacgttgccactgaccgtaaaccgttttttacgcttacgccctggtacacataaagaagatattttgcctgcactgaaacgtgtccaggccgggcacctgattaacgcaccgatgcaaaagctctctggtggcgaaacgcagcgtgtactattagcgcgagcattgttaaatcgcccgcaattattagtgctggatgaacccactcaaggcgtggatgtaaatggccaggtggcgttatatgaccttattgaccaactgcgtcgtgaactggattgtggcgttttaatggtttctcacgatctgcatctggtgatggcaaaaaccgatgaagtgctgtgcctgaatcaccacatttgttgttccggcacaccggaagttgtttccctgcatccggagtttatttcaatgtttggtcctcgtggtgctgaacaactgggtatctatcgccatcatcataaccatcgtcacgatttacagggacgaattgttttgcgtcggggaaatgatcgctcatgattgaattattatttcccggttggttagccgggatcatgctcgcctgtgccgcgggtccgctgggttcgtttgtagtctggcgtcgtatgtcttatttcggtgatacgctggctcatgcctcattacttggcgtcgcgtttggtttgttgctggacgtgaatccattctatgcggtgattgccgttacgctgctgctggcgggcggtctggtatggctggagaagcgtccacagctggcgatcgacacgttattagggattatggcgcacagtgccctgtcgctgggcctggtggtcgtgagtctgatgtctaatattcgtgttgatttgatggcttacctgttcggtgatttgctggcagtgacgccagaagatctcatctctattgcgattggcgtggtcatcgtggtggctattttgttctggcaatggcgcaatttgctgtcaatgacgataagcccggatctggcgtttgttgatggtgtgaaattacagcgagtgaaattgttgttgatgctggtgacggcattgacgattggtgtagcgatgaaatttgtcggtgcgttgattattacttcgttgctgattattcctgctgctactgcgcgtcgctttgcccgcacgccggaacagatggctggtgtcgctgttttggtggggatggtggcagtgactggcggtttaaccttttccgcggtttacgatacgccggcgggtccgtcggtggtgctatgtgcggcactgttatttattctcagtatgatgaaaaagcaggccagctaatctatcgctgaacacatttgtcggatgcggcgcgagcgccttatccgacctacggttcggtatctctggtagtcctggtaagacgcgaacagcgtcgcatcaggcatattgccagtgccggatgcggcgcgagcgaccaatccgacttacggcatttctggcggcgttatgccaaagtgattccacgcccgcgtcgtcgccatacgcccacgcggtgtacgctgcaaaaagccttgctgaatcaaataaggttccagcacatcctcaatggtttcacgttcttcgccaatggctgccgccaggttatccagacctacaggtccaccaaagaacttatcgattaccgccagcaacaatttgcggtccatataatcgaaaccttcagcatcgacattcaacatatccagcgcctgagcagcgatatctgccgagatggtgccatcgtgcttcacttcggcgaaatcacgcactcgacgcagcagacggttggcaatgcgcggcgtaccgcgagcgcgacgagcaacttccagcgcgccgtcatcactcatctcaagccccataaagcgtgcgctgcgactgacgatatattgcagatccggcacctgataaaactccagacgttgcacaataccaaaacggtcgcgcaacggtgatgtcagcgaacctgcgcgcgtggttgcaccaatcagggtaaacggcggcaaatcaattttaatggagcgtgccgccggaccttcaccaatcatgatatccagttggtagtcttccattgccgggtacagcacttcttcaacaactggcgatagacggtggatctcatcaataaacagcacgtcatgcggttcaaggttagtgagcatcgcagccaaatcgcccgccttttccagcaccggaccagaagtcgtgcgtaaattaacgcccatttcattggcgacaatgttggcaagcgtagttttacccaaccccggaggaccaaaaatcaacaaatgatcgagggcatcgccgcgcagtttcgctgctttgatgaaaatctccatctgtgaacgaacctgcggctgaccaacatactcttccagtaatttggggcgaatggcgcgatctgctacatcttccggcaaagtggtaccggcagaaatcagacggtctgcttcaatcatcctttacctcataacgcggcgcgtagggcttcgcgaattaaagtttcactgctggcgtcagggcgagcgattttgctcaccatgcggcttgcttcttgtggtttatagcccagcgccaccagcgcggcaaccgcttcttgttcagcatcgtcggtcgccgggctggcaggagacgtgagtaccaggtcggcggctggcgtaaagagatcgccatgcaaacctttaaatcggtctttcatttcaacaatcaagcgttcggcggtttttttgccaatacccggcagtttcaccagtgcccccacttcttcacgctcaacggcattaacgaactgctgcgctgacattccggagaggatcgccagcgccaacttcgggccgacgccgttggttttgatcaactctttgaacaatgtgcgctcttgtttattgttaaaaccgtacagcagttgcgcgtcttcacgcaccacaaagtgggtgaaaacgatcgcttcctgacccgcttcagggagttcataaaaacaggtcatcggcatatgcacttcatagcctacgccgcccacttcaattaacaccagcgggggttgtttttcaatgatgatgcctctgagtctgcctatcacatgacgctcctgcgtaatgaatcaaagataatgctgtatgataaaaaaatgctggatagatatccagcgaaggatgaagaaaacttgcgaggtgtctcgatgaactgaaaaatggcacagtataatttattctacaggttatattggaagcaaatattttaatattacatattcagtgaagaaatgcgtaataaaaatatacattgcgcctcctgaaaaaataaattttttatgctattacgtatatttgtatctatttcaatggaatgacaacgtgaatattaattaccctgctgaatatgaaattggagatatcgtctttacatgtataggtgctgccttatttggtcaaatatcagctgcatcaaattgctggagtaatcacgtcgggatcattatcggtcataacggtgaagacttcctggttgcagaaagccgggttcccctttcaaccatcaccacgctatctcgttttattaaacgttcgtctaatcaacgctatgctataaagcgattagacgctgggctgacagaacgacaaaaacaacgaattgttgaacaggttccctcccggctacgcaaactttaccacaccggttttaaatacgaatcttcgcgccagttctgttcaaaatttgtttttgatatttataaagaagcgctatgtattccggtgggtgaaatagagacgtttggagaattgttaaatagcaatccgaatgcaaaactcactttctggaaattctggttcctgggttctattccgtgggagcgtaaaaccgtcacgccagccagtttgtggcatcatccgggtttggtgttgattcatgcggagggagtggaaacgcctcagccggaactgaccgaggcggtataacttaacgcagtcgccctctcgccaggttcagccgcgattcgctcatctgcatcgcattctgactaacgtggcagtgggtgatagcaatcgccagcgcatcggcggcatccgcctgtggattagcgggcagtttcagcaaggtgcggaccatatgctgcacctggcttttttcggcactgccaatacctaccaccgtttgctttacctgacgtgccgcgtattcaaatactggcaactcctgattcaccgccgccacaatcgccacgccgcgcgcctggcccagtttcagggctgagtcagcgttctttgccataaagacttgttcaatggcgaaataatcaggctggaactgggtgatgatttccgtcacgcccgcatagatgagtttcagacgagacggtaaatcatccactttggtgcggatgcatccgctacccaggtaggacagttgcctacctacctggcggatgacgccgtagccggtcacgcgcgaacccggatcaatgccgagaataatagccatcacgcgtctccgttttgctgtttagcaggcctcatcagagagtcgctgcgacctcatcagagatttcaccgttatggtaaacttcctgcacgtcgtcgcaatcttccagcatatcgatcagacgcatcagtttcggtgcggtttctgcatccatatcagctttggtagacgggatcatggaaacttccgcgctgtctgctttcagacctgccgcttccagagcgtcgcgcactttacccatttcttcccatgcagtgtagacatcaatcgcgccgtcatcataggtcacaacgtcttcagcacctgcttccagtgctgcttccatgatggtgtcttcatcgcctttctcgaaggagatcacgccttttttgctgaacagataggcaacggaaccatcagtaccgaggttaccgccacatttgctaaatgcatgacgcacttcagcaacggtacggttgcggttgtcagacagacattcaatcatgattgccgtgccgccaggaccgtaaccttcgtagatgatggtttccatgtttgcatcatcatcaccgcccacaccacgtgcaattgcgcggttcagtgtgtcacgggtcatgttgttagacagtgctttatccaccgccgcacgcagacgcgggttagcgtccggatcgccaccgcccagcttagccgcggttaccagctcacgaatgattttagtgaagattttaccgcgcttagcatcctgcgcagctttacgatgtctggtgttggcccatttactatgacctgccataaaaatatctccagatagccctgcctgttcaggcagcgttaattacaaactgttcaatcgcctgccggttgctccaggacttagtgagcgccgccgcagcaggcgcatcaagccacttgtaagccagatgttcagtgaaaacgatctgccgctcgtgcggaagcgcaagacagaaccatgattccgtattacgcgtcacgcccggcgcatagcgatgacgtaaatgtgaaaaaatttcaaactctaccgtgcgctgacagtcaattaaggtcagttgttcagcgacaacatcaatggtgacctcttcctttacttcgcgcatggcagcttgcggcgcggtttcaccctcttccacgctgccggttaccgactgccagaaatcgggatcgtcacgccgctgcaacatcagcacccgtttcgtatcttgtgcgtagatgaccactaagatcgaaacgggacgcttatacactttatccttcacgctgcctcttcgttgactgccttcgctcatcccattcacatagttatctatgctcatgggagttcactcagttgccgcctcgatgcaacgcgaatgatttcgtgtatttgagtcatatcagttattctcagccttcttcacaacctgaatgctcagctcagccagtgcagtcgggttagcaaagctcggtgcttcagtcatcagacacgctgccgccgtggttttcgggaaggcgataacgtcacggatattgtcggtgccggtcagcagcatggtcagacggtcaagaccgaatgccagacctgcgtgcggcggagtaccgtatttcagagcgtcgagcaggaagccgaatttctcgcgctgttcctcttcgttgatacccagaataccaaacaccgtctgctgcatatcaccattatggatacgtactgaaccaccgcccacttcgtaaccattgatgaccatatcgtaagcgttcgccaccgcattttccggtgcagctttcagttctgcagccgtcatatctttcggtgaggtgaacggatggtgcattgccgtcaggccgccttcaccgtcgtcttcaaacatcgggaagtcgataacccacagcggtgcccatttgctttcgtcggtcagaccaaggtctttacccactttcaggcgcagtgcacccatcgcgtcggcaacaattttcttgttgtcggcaccgaagaaaatcatatcgccatcttgcgcggcagtacgatccaggatgtcttcgatgatttctgcattaaggaacttcgctaccgggctgttgataccttccagacctttcgcgcgttcgttaactttgatgtaagccagacctttcgcgccgtagattttaacgaagttaccgtattcgtcgatctgcttacgggtcagcgatgcgccgcccggaacgcgcagagccgctacgcgacctttcggatcgttcgccggacctgcaaatacagcaaactcaacagatttcagcagatcagcaacgtcagtcagttccatcgggttacgcagatccggtttatcagaaccataacggcgttctgcttccgcaaaggtcattaccgggaaatcgcccagatccacacccttcacttccagccacagatgacgcaccagcgcttccatcacttcacgcacttgcggcgcggtcatgaaagaagtttccacatcgatctgagtaaattcaggctgacggtcagcacgcaggtcttcgtcacggaagcatttaacgatctgatagtaacggtcaaaaccggacatcatcagcagctgtttgaacaactgcggggattgcggcagtgcgtagaatttacctttgtgcacacgagaaggcaccaggtagtcacgcgcgccttccggcgtggctttggtcagcatcggagtttcgatgtcgaggaagccgtggtcatccataaaacggcgcaccaggctggtgattttagcgcgggttttcaggcgctgagccatttccggacgacgcaggtcgaggtagcggtatttcagacgcgcttcttcggtgttgacgtggttagagtcaagcggcagaacatctgcgcggttgatgatagtcagcgaggacgccagcacttcgatttcgccggtcgccatatcgcggttaatatttttttcgtcacgcgcacgtacggtgcccgtgacctgaatgcagaactcattacgcagttcagaggccagctttaacgcgtccgcacgatccggatcgaaaaatacctgcacgataccttcgcggtcgcgcatatcgatgaagatcaggctaccaagatcacgacgacggttgacccaaccacacagagtcacctgctgccccacgtgggacaaacggagctgtccacaatattctgtacgcatgagatatcccttaacttagctgccggcggatgccccctgctgcgcaggtgaccaagtcgcagcgttagctgtatgtcacaactgaatgaaaaaaggcggctattatactggaaattctgccgcaccgtaagagcctggcccgcgctggaacgcctcgttaccactttatatcgggcctgaaatcagactctacgccagtttgctataaaggtgttgcccgaactcataaaaattaacaaaatttgtcgttccgccatcggctaatcgcattaaggtgtgaggcacgattttgttttttcaggagtcattatgcttgaacttaatgctaaaaccactgcgctggtggtgatcgatttacaagaaggcatcttaccttttgccggtggtccacatactgccgatgaggtagttaatcgcgccgggaagctggcggcgaaatttcgcgccagcggtcagcccgtgtttctggtgcgcgttggctggtctgccgattacgctgaagcattaaaacagccggtcgatgcgccctcaccggctaaagtgttgcccgaaaattggtggcaacatcctgctgcattaggtgcaaccgacagcgatatcgaaatcatcaaacgtcaatggggtgcgttttacggtacggatctggagttgcaattacgccgccgaggtatcgatacaatagtgttatgtgggatctcgaccaatatcggtgttgaatccaccgcccgcaatgcctgggaacttggctttaatctggtgattgccgaagacgcctgtagtgccgccagcgccgagcagcacaataacagtatcaaccatatctacccgcgcatcgcccgtgtgcgtagcgtggaagagatcctcaacgcgttatgatttacatcggtctaccgcaatggtcgcatcctaaatgggtgcggttggggatcaccagccttgaagagtatgcccgccactttaactgcgtggagggcaacaccacgctttacgccctgccgaaacccgaggttgtcctgcgctggcgtgagcagaccacagatgacttccgcttctgttttaagtttccggcgaccatttcgcatcaggcagcattacggcattgcgatgatttagtgactgaatttttgacccgcatgtcaccgttggctccgcgcattgggcaatactggctgcaactgcctgccacattcggcccacgggagctgcctgcgctttggcattttctcgattctcttcctggcgaatttaattatggcgtggaagtccgccatccacagtttttcgccaaaggagaagaggaacaaacgcttaatcgcggtttacatcagcgcggcgttaatcgggtgattttagacagccgcccggttcatgcagcacgtccacacagtgaagctattcgcgacgctcaacgaaaaaaacctaaagttccggtacatgctgtactgacggcgacaaatccgctgatccgttttatcggtagtgatgatatgacgcaaaaccgggaattatttcaggtctggttacaaaaattagcgcagtggcatcagaccactacgccttatctttttttacatacgccagacattgcccaggcaccggaactggtacataccctgtgggaagacttacgtaaaacgcttccagagatcggagcagttccggctattccacagcaatcttctcttttctgaatttgccacctatcatagacaggtgccatcggccattttaaagggagtttgtatggtaagcgcgctgtacgccgttttaagtgcgttgttattaatgaagttctcttttgatgtcgttcgcctgcgaatgcagtaccgcgttgcctatggcgacggcggttttagcgaactgcaaagcgctattcgcattcatggtaacgcggtggaatatattcccatcgcgattgtgctgatgctgtttatggaaatgaatggcgcagaaacctggatggtgcatatttgcggcatcgttttgcttgctggtcgtctgatgcattattacggttttcatcaccgtctgttccgctggcgacgttccggcatgagcgccacctggtgtgcgctgttgctgatggtgctggcgaatctttggtatatgccctgggagttggttttctccctgcgttagcgcacaatacgccactttctttttcccggatttttacgttatgtctcaccgcgacacgctattttctgcccctatcgccagactgggcgactggacctttgatgaacgggtagctgaagtcttcccggatatgatccagcgttccgtacccggctattccaatattatttccatgattggtatgttagccgagcgcttcgttcaacctggtacgcaggtttacgatctgggttgttctctgggcgcggcgacgctctcggtgcgtcgcaacattcatcatgataattgcaaaattattgccatcgacaactccccggcgatgattgaacgctgccgtcgtcatattgacgcctataaagcccctacgccagtagacgtcattgaaggtgatattcgcgatatcgccattgaaaacgcatcgatggtggtgctgaattttaccctgcaattcctggaaccttccgagcgccaggcgttactggataaaatttatcaagggctgaaccccggcggcgcgctggtgctttcggaaaaattcagtttcgaagatgccaaagttggtgaactgttgttcaacatgcaccacgactttaaacgtgccaacggttacagcgaactggagatcagccagaagcgcagcatgctggaaaacgtgatgctgaccgattccgtggaaacccataaagcacgcctgcataacgccggttttgagcatagtgagctgtggttccagtgctttaactttggttcactggtggcattaaaagcagaggacgctgcatgatcgactttggtaacttttattctctgattgccaaaaatcatctttcacactggctcgaaacgctgcccgcgcagattgctaactggcagcgcgagcagcagcacgggttgtttaagcagtggtcaaatgcggtggagtttctacctgaaattaaaccgtatcgtcttgatttattgcatagcgttacggcagaaagcgaagagccactgagcgcagggcaaattaaacgcattgaaacgctgatgcgcaacctgatgccgtggcgcaaagggccgttctcactgtatggcgtcaacatcgataccgaatggcgttccgactggaaatgggatcgtgttctgccccatctttctgatttaaccggacgcaccattctggatgtcggctgcggcagcggttatcacatgtggcgcatgattggcgcaggcgcgcacctcgcggtggggatcgaccctacgcaactgtttctgtgccagtttgaagcggtgcgtaaactactgggtaatgatcagcgcgcgcatttgttaccgttaggtattgaacaacttccggcactgaaagcctttgataccgtcttttcgatgggcgtgctttaccatcgccgttcaccgctggagcatctatggcagttgaaagatcaactggtcaatgaaggtgaactggtgctggaaacgctggttattgatggtgatgagaacacggtgctggtaccaggcgatcgttacgcgcaaatgcgtaatgtctatttcatcccttccgcgctggcgctgaaaaactggctgaagaagtgtggttttgtagatatccgcattgcggatgtgagcgttaccaccacagaagagcagcgacgcaccgaatggatggttaccgaatcgctggccgatttcctcgacccacatgatccgggtaaaacggtggaaggttatccggcacctaaacgcgcggtgctgattgcgcgcaagccgtaaaggtctggtattactgccggatgcggcgtgaacgccttatccggcctacaaaaccttgctaattcaatatattgcagggactatgtaggcctgataagcatagcgcatcaggcagctttacgtttgcataacctcagcgcccgtttccgggcgctattcacgtcttacgcctgaacagctggctgatcaaacgccgttaacttcggtgcattgcccgtatatttttcgatatacaccaacgctgagttaccggcacaggcatttgccagctgcgagctggggatatccgccgttaacacgttcgcactgccgtttttacacaagccattttccagatctggccatgcaccttcatgcacgcataccacgccttttttgatcccgtcagtcaccaccgcgcctgtcaaaatctgaccacgtttgttccagacacgcaccagatcgccattcgcaataccaaagcgtgcagcatcttcggtgtgaatagtgattggttcacgatcggcgatcgcatattttttacgcagttccgcatagttaagctgactgtgtaaacggtgtgccggatgtgcggtcagaagctgtaactgcttctcgtcggcggtacctttccattcatcaggagccagccaggttgggtgtgccgggcaatccttatagccaaatttttccaacgtttttgaatagatttcaattttgccgcttggcgtacccagcgcatttttcaccggatcggcgcggaaatcaccataacgaacgtactgttcgttcttctcgctgtggcgcatttcgatcagtttattttgctgccagaaggcattaaacattggcatagtgacgcgttgcgcacgggcacctttctgagcggcatcatagaaaaatttcagccacgccatttcatctttaccttcggtatagatctcttttccgccaggtttgagtaattccgcaagatcggcaaacacgtcaaaatcgttacgcgcttcaaattgcggagcaacagcctgcttcatcggcacaatatgctggttgctgtaatcaccggtcatcgtcaagtcattgcgctcaaacgatgtggtgatcggtaatacgatatctgcgtgtttggctgctgcggtccagtagcattcagaaacgacgatcatctccggtttctgccatgctttaatcagacgattagtatcctggtgatgggtaaagttaccgccacccgcccaccagatcattttgatattcggatacgtttgttctttaccgttatgctgatatttgccgccaggattttccagcgcatcgacgatacgggcaacaggaatcgccgtcattccgccatcatcagcggcctcgctggcatgtccggcaatcgccgcagacatttccggcagcacgccgccaacacgcgtcgggttgccaccgttggagtaatgataagagaaaccaaaaccgccgcccggtgtaccaatctgccctaacatcgccgccagcgtcaccagcatccagtgtttctgttcaccatattgctggcgctgaattccccagcctgccatcagcattgtgcgattcgccgccatcagttcagcgagtttgactatctgcgcttccggtacgccagtaatttccgccgcccagaccgcgctcttcggcgtattatcgctcttacctgtcagatactcttcaaactgcggatacccggtagtgtatttttcaaggaacactttatcgtgtttgccttgtgtcatcagggtatgcgcaatccctaacatcagtgccacgtcggtgcccatattcggcgcgatccaggtggcattatcgtcaaagaattcgatggtttcggagcggataggatcaatggcaatcactggtttgccagattttttcagctgatggaagtattccagcccttgctcatcggtactgctccaggcaatttttaaggtattcagcgggttcattccccacagcaccacaacctggctgttttccagaatcagcggccaggaggtctgctgttcatacacctctacagaaccgaccacatgcggcatgatcacctgtgctgccccggttgaataatcgccgctatgcccggaataaccgcccgccaggttcatataacgttgcagtaaggtttgcgctttatgcaacacgccagaagagcgccagccgtaagatccggcaaaaatggccgatggtccgttagctttacgaatacgatcatgttgctcatgaatcagttttaatgcctgttcccagctcacctgtacataggtatcttcgccacgacctttcgccggttgcagtggattatcgagatagctttttctcaccatcggatgctgaatacgcgccgtggtgtgtacctgatccgccgccgtagactgtaaggaattcggtatggttttcgccagcgcgcctgttgaagaaacaatcttgccgtccttcacttctacgttcatcgctccccaacgtcccgcggtgaggattttaccgcccttctcttctgcccatgcggggagcggtgctgccgatgtcaccaccagcgctccagcggcaataccgctgtgtttaataaattcacgtcttgttaatgtcataacttcctccctgatcaacgaggatcactgtttctcggtaatatctttggcgttgtactggaaataccgcgttaaaatgtccagttcgttttcgctcatgctggttcgtgcccccattcctttggcaatggacggccacgcattgacggtgtaatggtcggcggcaataggggcatgacaaccagcgcaataggtatcgtcaagtttttcagcgtattgccatagcggtttacggtccgctaatgcgggatcggtaagcgcaccctgtaaagacgcctgacgccattgattgccgtattcgtcagcctgccattccccgtttacagtgagcgccttgataccttcttcacttaatgtggctagcgccagccgttgacctgccgccaggtagagcgtgttttcactgccctgcatttgataaccctgcaacagaacgatcggctgtttgccactggcatcaacgacggtgagatcggttccaggattcacggtagccagctcgcctatgtgagaagttttgaaaggataaatatgtgcgccattagtaactgaagtagcggcctgactttccagctcatgcgccgcgttgtcatccatttttatttctggcggaaaatgggcaatgcctttatgacaatcgatacaggtttcgctgtccttttgtgctttgttatgcattttctgcgcagattcactttgcgaggcaatatccatggcatcaaaagaatggcaactacggcacgttgcagagtcagtggcttttaattctttccatactgtttcggccatttcctggcgatgagcttcgaacttatcgtcactgtctattttgccgctaacaaattcatgataaatatctttagatgcctttaatttagcaaataaataatccatccctgactttggaatatggcaatcggcacattccgcacgtatccctttctggttcgaaaagtggacagttccctgatattcctcaaaaggtttactcatcgagtggcaggaaaggcaaaatgctgtatccgacgttttatgtaagactttttgcgccagcaataacccgccgccaccaaccacaaccgctatcagcaaaaacaataacccaatgcgttttttccctcgcatagattcctctaattaaattactggacaccgaaatcattgtataattaaatatacaacgaattaaccgcttgcataattaggcacaacactgcctgaaacaatcgataaagaatatgatttattacaatgtaatcattaattgctaaggaataacccagttgctatttagaatatatatttatcagttttagtaatttaaatcccataattaatgtgaatatatacaatatttttagcacaacgctatgcgcactgtcacccgctcaacagatcacggttatcgttcgttttttatactgttcagggataaaaaaaggcccctgttgaaattgcaggggcctggtacgagcaagcatcatattgggcgacatgatgcaacggtaaaaatcatttggcctgatggcgttcaatgattcctttcatttcagcaaccgccgccccgtctacgatataacgcgaatactcgtccgcgtgttcatctgatgacatggacaatccttgattacgataacgcatcggtgaggcttgccacgctcccgcggagctatggacttccagcactccggcatcgaggaagtggtgcaggttttctgcacggactcctgctccggccataatgattggagcatcacgatgggcaataagttccataatttttgataaaccttgcagtgcgtctgatttttgccctgatgtcagtacccgggcaatgcccaattccgcaagattattgagtgtatataaagggttagcgcacatatcgaaggcgcgatgaaaagtcactgccagcggaccggcagcagccattattttttccattcgtggcatatcgacattcccgtcaacatcgagaacgcccgtcaccagtccaggaaaacctaattcgcggaccgtgcgcacatcctcaagaatggcggcaaactcaccgtcgctgtagcaaaaatcaccaccgcgtgggcgaattatcggatgcacagggatcgtcacccgctggcgcacggatttcagtacacccaacgacggcgttaagcccccctcttttggggctgcgcataattcaactctgtctgcgccgttttgctgcgccgttagtgcacattccatgctgtaacagcaaatttccagtaatgccatttttactccttaattacgccgactgctcgctggcaacgatctcttcaatggaccacggatgaaacttaatagttgttttgccatcggtgaccgccagcgtcggattcggtaatcgctcatgctcaccttttggcgaactggttttcactgagatccccggtaggctgagtccttcatcagaaagcaatgccagcgcacgggcattcagcgtttctggatcacccggcagaacgatttcaatatgttcccaaccttcgtgtgggtaacgtttttccccgggccacggtagctccacaatagaaaactgccagtgcgcaacctgtaccggttcatgcaatttaaacagacaaatcggtctgccattgatcatattttctgacaaaagctcgccacactgttcaaacccgcgacgccagcgttcagcagtggcgttttgatggcaacgcaaagaaatgtgatcggcagtcagcggagtgatattcaaccccagacggcgggaaagttcatctaatgcgtggataaatcgcggtaaatccgatgcaatatcctgcagctcgtcgatagattgccagttcgccataatcactcttcgtctttcagtaaaagcgttaatttaccctgttgccctgtgccaaccaaccgctgatttcacgccgcttctgatgcaatagtgaaaacggcaatacgccacgcgcacgttgctgacgaaaacagccatttgcagtatactcccgccctaatttctttaactggtgcgggcaatttttgctcgcttcatcaatgtaaggtattccggtgaatattcaggctcttctctcagaaaaagtccgtcaggccatgattgcggcaggcgcgcctgcggattgcgaaccgcaggttcgtcagtcagcaaaagttcagttcggcgactatcaggctaacggcatgatggcagttgctaaaaaactgggtatggcaccgcgacaattagcagagcaggtgctgactcatctggatcttaacggtatcgccagcaaagttgagatcgccggtccaggctttatcaacattttccttgatccggcattcctggctgaacatgttcagcaggcgctggcgtccgatcgtctcggtgttgctacgccagaaaaacagaccattgtggttgactactctgcgccaaacgtggcgaaagagatgcatgtcggtcacctgcgctctaccattattggtgacgcagcagtgcgtactctggagttcctcggtcacaaagtgattcgcgcaaaccacgtcggcgactggggcactcagttcggtatgctgattgcatggctggaaaagcagcagcaggaaaacgccggtgaaatggagctggctgaccttgaaggtttctaccgcgatgcgaaaaagcattacgatgaagatgaagagttcgccgagcgcgcacgtaactacgtggtaaaactgcaaagcggtgacgaatatttccgcgagatgtggcgcaaactggtcgacatcaccatgacgcagaaccagatcacctacgatcgtctcaacgtgacgctgacccgtgatgacgtgatgggcgaaagcctctacaacccgatgctgccaggaattgtggcggatctcaaagccaaaggtctggcagtagaaagcgaaggggcgaccgtcgtattccttgatgagtttaaaaacaaggaaggcgaaccgatgggcgtgatcattcagaagaaagatggcggctatctctacaccaccactgatatcgcctgtgcgaaatatcgttatgaaacactgcatgccgatcgcgtgctgtattacatcgactcccgtcagcatcaacacctgatgcaggcatgggcgatcgtccgtaaagcaggctatgtaccggaatccgtaccgctggaacaccacatgttcggcatgatgctgggtaaagacggcaaaccgttcaaaacccgcgcgggtggtacagtgaaactggccgatctgctggatgaagccctggaacgtgcacgccgtctggtggcagaaaagaacccggatatgccagccgacgagctggaaaaactggctaacgcggttggtattggtgcggtgaaatatgcggatctctccaaaaaccgcaccacggactacatcttcgactgggacaacatgctggcgtttgagggtaataccgcgccatacatgcagtatgcatacacgcgtgtattgtccgtgttccgtaaagcagaaattgacgaagagcaactggctgcagctccggttatcatccgtgaagatcgtgaagcgcaactggcagctcgcctgctgcagtttgaagaaaccctcaccgtggttgcccgtgaaggcacgccgcatgtaatgtgtgcttacctgtacgatctggccggtctgttctctggcttctacgagcactgcccgatcctcagcgcagaaaacgaagaagtgcgtaacagccgtctaaaactggcacaactgacggcgaagacgctgaagctgggtctggatacgctgggtattgagactgtagagcgtatgtaatcgatttttcgtgagagtgaagcctgatcagggttagccgatcaggcttttttattgccatctaaatgtattctgaaaatggacatgccattgttttctcactgttggataagaggccagaagcgtaatatccggccccagggaaacgataacggttgaatttaaggaataccgcagtgtttaaatttcttgtattaacattaggcattatctcttgccaggcttacgcagaagatacggttatagtaaacgaccatgacatttcagccatcaaagattgttggcaaaaaaattcagatgatgatactgacgttaacgtgatcaaatcatgcctgcgacaagaatacaatctcgtcgatgcgcaattaaataaagcctatggtgaagcttatcgttatatagaacaagtgccacgcacaggtgtaaaaaaacctgataccgaacaacttaacttgcttaaaaaatcacagcgagcctggctggattttagggacaaagaatgtgaattaatcctttcaaatgaggacgttcaggatttaagtgacccttattctgaatcagaatggctctcatgtatgatcatacagaccaatacgcgaactcgccagttgcagctataccgtaactctgaagatttttatccaagccctttgacaagaggataattcacatctttttggcatgttttgttgcaagctattcctgataaataattgcaacaagacatcgagcctttttcactgagttattaaacatactcgcgagcgcgtaatttttttgtccttcagcgataattcacaatcacttcattacgttgtacctttagcggtggaattaaccgcccaccgcctggcacttcccagataaatcgcaacggttctgctgccgctataccggaaaaggccacggtggttccgctctgcccctctaattcgacacaacgagattgcgaacacaagcgaacccgcagtcctgaaggtgtcgggccgataagctgataacgccacgctaccagcgtcatcaatcctgaagcaggttgtcgcgtagaaagaggcgcagacgacatcgactcaccgcgatgatttagcgtaattcctacactacttgcctgccacatcccctccccggcggcttgcaccagcagcggaaacaataatattgctaataaggttctcattatttgccgccaattgtcgccgtcatgcggatatgtcggttatcagacagttccagattcgacaggaccactaactgcggcaagctgcggcgcaggaagcgagacaataatggtcgcagcgcgtggttcaccaacaatactggcggcgcacccagcatctcctgacgggatagcgcttcctgagtttgcgccagtaaacgatccgccagccctggctccagtcctcccccgccctgcagcgcctgtagtaacaaacgttccagcggtgtatcgaggccaataacatggacttcatctttgccaggaaaccactgctgggtaatcgcccgtcccaacgccacgcgcacgacggcggttaattcatgtggatcgctttggatgggcgcatgttccgccagcgtttcgagaatggtgcgcatatcgcgaatcggtactttttcatcgaggagattttgcagcactttatgcagtgtggtgagcgtgacgacgccaggaacgagatcttccgtcagctttggcatctcctgggcgacgcgatccaacagctgttgcgcctcctgacgaccaaacagctctgcggcatgctggctaatgaggtggttaagatgcgttgctaccaccgtgctggcctcaaccactgtgtacccctgaatctgcgcctgttcttttagcgcactttcaatccagatagcattcaggccaaatgccggatcgacggtcgcctcaccaggtaacgtcccggcagcggttccagggttaatcgccagccagcgccccggataagcatcaccactgccaatctccacgcctttcatcaaaatgcgatagcgggcaggttgcagatccatattgtcgcgaatgtgcaccactggcggcagaaatcccatctcctgggcaaatttcttgcggatactgcgtatacggcccaacaactcaccatcctgctggaaatcgaccatcgggatcagtcgataacccacttccattcccagagaatcttccagttgtacatcgttccacgtcgcttcgacaacggtattattctctgccatttttaccggtttgggttcggcaggcgctttttgttcgcgtccgcgtatccaccaggccagcccgagcaatccggcagtgaacagcaaaaataccaggttcggcattccaggcaccaggccgagtaaaccgagcacggcggcgcttaacaacataacgcttgggttactgaaaagctgattcaccatctgctcgccaacatcctgatcggtgctgacacgcgtaacgatgacccccgcggcggtagaaatcaccagcgccggaatttgtgccaccagaccgtcgccaatggtcaatagcgtataactttccgccgcgtgtcccatgctcatgccatgttgcagcacgccgaccagcaacccgccgacaatgttaatgaccatgatgaggatcccggcgatggcatcgccgcgaacaaacttacttgccccgtccattgagccgtaaaaatcggcttcctgagtcacttcggagcggcgttttttcgcctcatcttcaccaatcaatccggcgttaaggtcggcgtcaatcgccatctgcttacccggcataccatcgagaacaaagcgcgcacccacttctgcgatacgcccggcacctttggtaatgaccataaagttgatgatcacgagaatgacaaacaccacgataccgatagcgaaattgccaccaacgaggaagtgaccgaacgcttcgaccaccttccctgccgccgccgcgccggtatgcccttccattaaaatgatacgggttgaagccacgttaagtgccagacgcaacagcgtggtaaacaacagaatggtcggaaacgcagcaaactcaagcgtgcgctgggtaaacatcgccaccagcaacaccatgatcgacaaggcaatattgaaggtaaacaacaggtcgagtatgaatgcgggcagtggcagcaccatcatcgacaagatcaacaggatcaaaatcggtccggcaaggatctgccattgtgtcgatttcaggtttgcgggcaggcgcagcatcgcggccagattactcatgggtcggtttctcgttaataaaatccagggcttccggcaccggaagatgagtaggttgtacagggcgctgtccaccagccagacgccagcgtttcagttgccagacccaggccagcacttccgccaccgcggcgtacagttgacccgggatttgttgaccaatctccgcatgtcgatacagcgctcgcgccagcggcggcgcttcaagcgtcgggacgttattttcagcgccaatttcacgaatgcgcagcgcgaccagccctgcacctttagcgaccactttcggtgcgctcattttgttttcgtcatactgcaacgctaccgaatagtgggtcgggttattgacaatgacatccgctttcggcacatcggccatcatccgacgccgtgcagcagctcgctgcatctgacggatccgccctttaacatgagggtcaccttcgctttgtttgaactcatcacgaatatcctgccgtgacatacgcagctttttcaggtggctgaatatttggaaaaagacgtcaaatcccaccattggaatgacaccaagcaccaccagcagtgcgcatagccctaccaaatccatcgcattacccatggcggtaatcggagactcggccatcaagcgcatcatctgcggccagtgatgccagagaaaaaaccccgtcacgctgccaaccaggatggttttcaaaattgctttaagcaactccgcgccagtctgagccgagaacatccgtttaatgcccggtagcgggttgagtttggaaaacttcggctgcaaggatttgccgctaaataccagccctcccagcatgaccggagaaatgagcgccaccagcaccacgccgctaatcagcggcagcagcgccagcatggcttctctgatcagcagaataatctgcccgaggatcagattcgggtcattgataatactgtgatcaaaatgcagcccagcggagagcatgcccgacaatcgacgggccagcgacacaccgccaaaccagataacactaacgcccaccagcaaaatcagcagtgaggtcagttcacgggaacgcgggatttgcccctcttcccgcgctttttctagtcggtgaggtgtgggggcttctgttttgtcgtcgctctcgtcagacacgtcgccaatcctggaaagagtattaagcgtgaatgatgccagagcgcaaagcgttcaatggtttgagtaaggggcaaaacaggcgggatttagggcttttgctgccacacatcaagcatagtgtgcgtttgtcggatgcggcgtcatcgccttatcagaccgcctgatatgacgtggtcacgccacatcaggcaatacaaatcaaaatccaagactatccaacaaatcgtccacctgatcctgactggctaccacaccggctttgctggtatcgacctgaggtccattaagcaaactctggttttcacgttttggacgcgactcctgttccgggatgttttccaacagcaccatcagcaactggcgttcgatctcctgaatgacatccatcatccgcttaatgacctgcccggtgagatcctgaaaatcctgcgccatcatgatttccagcagttgcgcgttagtaaagctggtatgcgcgggtacatctgccagaaattgtcgtgtatctgttaccagttcacgggcgtcggcaaggtcaatcggatcggcaaaccagtcatcccaacgttgggttaacgcttttgctgatttctccatttgatcctgatgcggttgtgacgcctcaacactgttcagcgcccgctccgcagcctgggcggtcatctgcacaacatagtacaaacgatcgcgcgcatcggggatggcttccgccgcttcggcaatggcctgatccagccccagttcccgcaaactgtcgcgcagcatacgcgtcaggctgccgatgcgcgcaatgatatcgccagctgaatgctcgtcagcaggtttgattgatggttgcatcatagtcgcatcctcacatgcccagtttctcaaagattttgttgagtttttcctccagcgtcgcggcggtaaatggcttcaccacatagccactggcccccgcttgcgccgcagcaatgatgttctctttcttcgcttctgcagtcaccattaacactggcaatgccgacatcgcgccatccgcacgaattgttttcagcaattccaggccatccatattgggcatgttccagtcggagataacaaatccataaccgcctgcctgcaacttattgagagcgtcgacgccatcttccgcttcctcaacattattgaatcccagctctttcagcaggttacgcactatgcgtcgcatggtggaaaagtcatccacaaccaaaaatttaagttctttatccgccatttcacactcctgatttaaatacgtatcgcctgtccggcactaatttttgccaacatttgctggcttacctggctaagatcgaccacttcgcagacaccacccatattgatggcctcgcgcggcatgccgaacaccacgcaacttgcttcgttttgcgcaagggtccatgcccccgcctgacgcatcgccaacattcccgccgcgccgtcgttgcccataccggtcaggatcaccccaaccgcattacgccccgcctgtttggcgacagaatggaacaacacatctaccgaaggccgatgacggttaaccgccgggccatcgtgaattttgatttggtaatttgcgccactacgcgacagctccatatgccgatcgcccggcgcaatataggcatgccccggcaagacacgttctccgtcttcggcttctttaaccccgatctggcaaagcttattaagtctgtcggcaaaagagcgggtgaaaccgggcggcatatgctgggtaattaacagtgccgggctggaaagcggcaacggttgcagtacgtgacgaattgcctcagttccacccgttgaagcaccaatcgcaatcagtttttcagaactcaacaacggccccgccttcagcgttgtcggtgccgacaatggcttatgtgctgcaaggctcgcctttgctgccgtacgcaccttttcagcaatcatttcgttatacgccagcataccttcgcgaatacccagttgcggtttggtgacaaaatctatcgcccccagctccagcgcgcgcagcgtgacttctgaccctttgccggtcagggaagaaaccatcacaacgggcattggacgcaaacgcattaatttttcgaggaaatccagtccgtccatccgcggcatttcaacatccagcgtcagcacatcgggattgaatttcttaatcaagtcacgcgcgaccagcggatcaggcgcggtcgccaccatttccatgtcgctatggctgttgatgatttctgtcatgatctggcgcatcagtgccgaatcatcgacagataacaccctgattttgctcatcgttaatccttacttagcgcatacaccgtctgaccacgcagcgtgaagcggcgctcaaggtggctaaagttttcagagtgacccgcaaacagcaatccgtcgggtttaaggagcggaacaaagcggcgcaaaatctcctgctgggtagtttgatcgaagtagatcatgacgttacgacagaagatcgcatcaaacggccccggcacggtgtactgtttcgccagtagattcagcggggcaaaatcaacatagttcgccagctcctgacgcacgcgtaccagcccttcatgcggccccgtccctcgcatgaaataccgttgcagttgctgcggcgtcaggtttttcaactcttcatggcgatagataccgcttctggctttttccagcacttcggtgtcgatatcactggcaaacactttccagcgtccgggcgcggtgcccaatgtgtcagccagcgtcatcgcaatgctgtacggctcttcgccggtcgaagccgccgcgctccatacgcgatactcgccagaacggcgacgtgcgtgatccgcgagcagagggaaatgatgtgcctcacggaaaaatgccgtcagattcgtggtcagcgaattgataaacgcctgccactcaccgctgtgctgattagattccagcaagttcagataatgaccgaaatccgtcagtcccagcgaacgcaaacgacgaaccagtcggttgtaaaccatgtcgcgtttatggtcagccagaacgatcccggctcgttgatagatcaattgacttatccgccgaaaatgcgcgtcggaaagcgccaggcgctcggtcatctgtaacaataaagacgtttgcccacagggcagagatgaagtcatagcgccttctcaatcacttcaggataccactggcgcaatttgtaactgcaccgactcatgtcgtgctacttcatgttcttcaagggtaaataccgccacacgcgacgaaagatggtcggcctgattcgccagttgttccgttgccaccgccgcttcttctaccagcgaggcgttctgctgagtcacctgatccatctggctgacagcctgtgcaacctgctcaatcccccgctgttgttcttccgacgcagaggcaatttctcccataatgtcgttcacgcgggtcaccgaactgacaatatcgatcatggtcgcggcggcgttattcaccagtttcgaaccctgctggacacgattgactgactcttcgatcagccctttgatctcttttgctgcctgcgcgctacggctggcaagattgcgcacttcacctgccactaccgcaaaaccacgcccctgctctccggcgcgagccgcttccactgccgcattcagggccagaatattggtctggaaagcaattccgtcgataacgctgataatgtcgccaattttttgcgagctggtggcgatctcctgcatggtgtgagtcatggtactgacctgaacaccgcccgcctgcgccgttgtcgcggcattttttgccagttccgacgcctgtcgtgcgttatcggcgttttgccctaccgtggcggttaattgctccatactggcggccgtttgtgccagcgatgccgcctgctgttcggtacgacttgagagatcgttattgcctgcgacaatctccgcgataccaatgtgcatctcctggcttcccttacgcacatcacttaccgtcccacgcaaagcctgctgcatggtcttcagactggcaaaaatggcggtgatctcattacgaccatataccgcaatcggacgcgccagattacccgcagcaatgctgtcaaaatggctaccgataatggccagtggttgaacaatcatcttgcgcgtccaccacagcgcactgctgatgtagatcgccgcaacaataatcatgctgataaacaccagtgccgaaatctgatagttacgctggctttgcgcactggcggcttccagcacatggttgatctccagctgccaggcctcaaagttaacgtcaaacgcattctgtgatccctgcaccggcgcagtgaggaaatccgaaagttgattactttcaagccaggtcgcctgatgttcgagatcgttgtgccagcgggcaaaacttttctccgtctctttttgcaatcccctgacgtgctcgttgcccgcagtcatcgccataaaacttttaaacagcgtggtggattgcgtcagactggcgcgcgccgtcgtcatcaacgttttaatgtcatccgccggatagctaagtgccgtcagagtgcccgctttgttcagcgcggtactggcctgtaacattaccgcccgagtttgcgctaatgccgcacgttgctgattgctctgctcgacctgattcagtcgttgcaaatcgtcgcgaaatgcccaaaaagacatgccgttactgccaatctgcaagatcccgcagagaatcaaaattaaaaacagcgtggtcgaaattcgaatacgattaaacatcaacgctccccatcaggcggcaatgaccgcgttagtaaatactcgtcaaaatgtttcccagtttggatcttgttcagcaattcgcagtcgtggctgagccggtggttgctcactggcaggacgggatggtgtttgcggtttattggtgagtgggctggctgccagacggaacgcggaaactgcttgcgttaaacgactcgcctgttcttccagcgcagcggcggcggcagctgattcctgcaccagcgatgcgttctgttgcgtgacgcgatccatttccgaaaccgccaatgcgacttgatcgatgccacggctctgttcatccgatgccgatgcaatctcgcccataatgtcagtcacgcgagtgacagcattgacgatattgttcattgtttccccggcgctttcgaccagcaccgaaccggtatcaacgcgtgagacggagtcttcaatgagggctttgatctcttttgccgcctgggcgctgcgactggcaagattacgcacttcacccgccaccacggcaaaaccacggccctgttcacccgcacgcgcggcttcaaccgcggcattcagcgcgaggatattagtctggaaggcaataccgtcgataacgctgataatgtcggcaattttcttcgaactatcggcgatctcatgcatcgttttcactacgccatccaccactttgccgccgtgctgggcggtgtcggaggcactttgcgccagttgcgaggcctggcgggcgttatcggcgttttgcttcactgtcgcggtgagctgctccatgctggcggcagtttcttccagcgcggatgcctgctgttcagtacgggaggaaagatcggtgttgcccgccgcaatttcacgggtaccggcatagatggcatctgaaccttcgcggacatgagtgacggtgtcagtcaaagagcgttgcatatgtgaaacgctctgcgccaggtcgcccatttcactgcgcccgtcaatggtcagggtattcgccaggttaccaccggcgatttcgcgaatgtgagcaataatttttgccagcggagtaagcaacatacggcgaatgccgtaccacgccaccagcagaatcaataccaccaccagcgcgataaccgccagttgccactgggcaaatcggtaatcatctgcgttgtcagtgacgatatcgcgatacagtttttcactgctgagggcgtactgagcaaacgcttcgcccattgcattttgcattccctgggttggctgagcgaaataagctccagtattgccataatctagataatcaatcagttcagttaacgctgtgtaatagtttttatatttttcatcaatattacgactggtagcgaccatttcaggtaacggtgccatgcttttgaattttttataatgcgtcgctgcctgcgccaatgttttcctggcgctatcgagcaattcaactttggcgttactttgttgattggaggaatccatcatcatccgtaccgctgaacgactcaggttaatgcgcgtttgcagcattaaatcccaggttgacgtcagctcgccctgctgttcccgtaattgattggaaaccacaaagctcttctggctatggtgaagggaagaaaaaaacagactgccggaaataagctgtaacagtgcgaatacccccagcaccattaccaacagcgtgactacgcggatacggttaatcataaggcaccttcctgaaaacaagttgatctcgttatcggcaaggaggggggaaactttattgctgatgccacccgccgcgaaattgaaataaaaaacccgatgcgcagatcatcgggttcatttcaattgaggaaatcgggagaattacgccacttctgacgccgcgctatctaacagcgccatctcttcgctgttcagcagtttttcgatgttcaccagaatcaacatccggtcgcccagtgcgcccagtccagtgagatattctgttgaaagcgtcacggcaaattccggtgccggacgaatttgctccgccgtcaatgaaagcacgtctgagacgccgtcaaccacgatgccgaccacccgctgtccgagattcaggacgataactaccgtgttgtcgttatagtccacatccacctggctgaacttaattcgtaagtcaacaatcggcacaataacgccgcgcagattcgtgacgcctttgataaacgctggcgtgttcgcaatccgtgttacctgatcgtagccacggatctcctgcactttcaggatatcaataccgtactcttcatcaccaagggtaaataccagaaattcctggcctgacggctcgctggccagctttgttacattcgtcataccggtcatattgttacctttttactcattcaggcggcggtgttcgccatacgttgttcgcggtttatcgcctgcaaggcggagacatcaacaatcagtgccacgctgccgtcgccaagaatggtcgcagcagaaatgccggggactttgcgatagttactttcaaggtttttaaccacaacctggtgttgaccaattaattgatccaccagcaaggcgtagcggcgaccgccactttgtaagatcaccacaattccctgggtggcttcggttttcgcgcccgcgacgttgaacactttccacagttcgacgatgggcagatattcaccccgcacttccagcacccgctcgccgccggccagtggatggagatcggcttcacggggttgcagtgattccataacagcattcagcggcagaatgaaaacttcatccgcaacgcgtacggacatgccgtcgaggatggccagcgtcagcggcagtaaaatgcggatcgtagtgccagtaccctgcttcgactggatttcgacatgaccgcccatcttctggatattacgtttaacgacgtccatgccgacgccgcgcccggagacgtcggtgacctgctctgccgtggagaagccaggtgcaaatatcagcatcgcgacttcgtcgtcgctcatgttttcgctgacagtcaaaccttgcgaggccgcttttgccagaattcgctcacggtttagccccgccccatcgtcggtcacttcaatgcaaatgttgccgccctgatgttcggcagacagaattaaatttccgacgctgtttttacctgcggcgagccgtttttctggcagttcaataccgtgatcgaggctattgcgtaccaggtgggtcagcgggtcgataatgcgttctatcaggcttttgtcgagttcagtagaactgcccaccagcgtcagttctacctgcttgccgagttttcccgccagatcacgcaccagccggggatagcgactaaaaacatattccatcggcatcatgcgaatcgacatcactgattcctgcaaatcacgggcgttacgttgtaactgccccatgctggttatcaaatcaccatgattaaccgggtccagttcgctggaacgctgggcaagcatggactgggtgataaccagctcgccgacgaggttaattaattgatcaaccttttctaccgctacacggatgctggtggattcattgctgcgcgtcgttttttcccgctccacgcggccggttggcgcttgttcggctgccagtttaagcactggtggggtggatatttttggcgagacttctactgtttcaaaggtaatctgatcggcttcaatcacaaaacagagtaccgctgtgatgtcatcttcggcgatgtcgcccggtaatattgccgagagcgaatccgcccctttcaccacgtcagttaacgttgtcagatgtcccagttcttcttccagcaggtcgacttccccggccttcaggcgcgaaaggataattcgtcgcggcgactgactgcgactctgctcatcttgcggttcacttttggcaaccacacttaatcgggtcactgcggatggcgtttcgcctttcgcttctaatgccagttgacgcaaggcctggcagatataatcgaagctggcggcatccggctcttgcgactgtttataagcgtcgagctgttcttgcatgatgtccttcgtttccaaaaacagattgataatgtcggtgttgagttgcatctcacctcgtctggcttcatcgagcaggttttccatcagatgcgtggtttcctgcaaaacgctgaagccaaaagttcctgcccctcctttgatcgagtgggcagcccgaaagatggcattcaattgttcggcatctggcgcttccggctgcaaaaccagcaaatgctgctccatgtcagccaacagttcgtccgcttcatcaaaaaatgtctgataaaaatcgcttatatccatgctcacgctgtcacctcggttcggctgatggcattgtgggaacactgacctgtggtgcaacctcaggtttttccagggcgcttactggctcattctggctttcggcgttttcatgcaaaatggcctgttcggcttgtttgttcagtaccagcaggctgatgcgacggttgacggcatcatcaggtccgcgatcgcttaagcgcatcgttgccgccatgccgacgacacgtaacactttgccgctatccaaccctccgaccatcagttcgcggcgggatgcattggcccgatcggcagaaagctcccagttgctatatcctttctcaccgctggcgtaggggaaatcatcggtatgacctgaaaggctaatacggttgggaataccgttcagtacaggcgcaatggcgcgcagaatgtcgcgcatatagggttcgacatcggcactgccggttctaaacatcgggcgattctggctatcgatgatctgaatacgtagaccttcctggaccagatcgattttgagatggggacgtaacgcccgcagtttcggatcggactctatcaactggtcgagatcaccccgcaatttccgcaatcgactttgctccatgcgttttttcagctcttcgatgttcggctgcttattcacttccccctggctttgggtgtaatcatcaccaccgccgggaattgggctttcactattagaaatgcgatcgccgcccgtaaccgcagtcgccagtggagtccggaagtactccgcaatctgaatcagctcttttgggctggagatggagatcagccacatcaccagaaaaaaggccatcatcgcagtcataaagtcggcataagcaatcttccacgatccatgtgctgccccgtggcttttggctttgcgtcgtttgacgacaataatcggatgcgcttgattcttcatgcttcctcggttgtcgtctgttgttgcggatttttcaccgcacgcacatgctcttccagttcaataaacgacggacgttcgctggaatagagcgttttgcgaccaaactcaacggcgataggcggtgcgtaaccgttcagattagaaagcagagtgactttgacgcactgcatcattttgctggtttcggcgcttttctgacgtaaaacagtcgctaatggggaaataaatccgtaagccaataaaatgccgaggaaagtccccaccatcgcatgtgcgataagcgcacccagctcggcggcaggacgatcggctgaacctaacgcgtgaacgacccccattacagccgcaacaataccaaacgccggaagtgagtccccgaccagcgccagactgttcgccgggacttctgcctcgctttcgtgcgtctcaatctcttcatccatcagagcttcgatttcgaaggtgttcatgtgaccgctgataatcaggcgcagataatcgacgataaaatcaagcatgacgctatccgcgaggatgcgtgggtagctggcgaagatctcgctctcacggggattttcaatatcacgttccagcgaaaacatccccatctgccgcgatttcgccatcaaccgataaagcagagccagcagatccatatacattgctttggtgtatttggagcgacgaaacagcaacggcagcgccttcagcgtgcctttaatcgctttgccattattgccgacgataaacgacccaatccctgcaccggcaataatcaccagttcagcgggttgatagagtgctccaaggcttccaccggtcatcaaataaccgccgaaaactgtaccgagaacaaccaggtaacctaataagataagcacgacatcatccttccactgttgaccatgacaggatgttcagtcgtcaggcgttaacgcgcgattggggcaaaaaaaagcagcggtacgtcgttaccgctgctggaatgttgcgcctcaccgtatcagttaaacagcctgtactctctgttcatccagcagttgtgggataatatcggcaggattctgggaaagtttacgtctttttactgcccgggatggcggttgacataagctgcaggcaaagctgccaacaggctggtgagcgtgggtaataaaattgccgccgcagcagttgcagctggaaagttgcagtaatccactttcaacaaaccgcaccaatgtccaggcacgggttaatgccagcagtggtccttcttctgcttgtgggcactgttcaaggtataaacggtaggctttgatcaccgcatcgacgccattacacaaaccggttttcagtaaaaactgccatgcattacagaacatcgaagcatgaacgttttgttcccaggtcataaaccagtcggttgagaatggcagcatgcctttcggcggtgggcttccgcgcagttctttataaagttttatcaggcgtccgcgacttaactgtgtttcgctttccagcatctgcaaacgagcgcccagggtgatcaattccattgccagctgaatatcccgcgcttcctgaacaatgcttttttcactcatgatcaggcccttttcttgcgcagcgcttcttcaggctgattaacatcattcagcaagcgtgttgagagcatgatgccggtatgaatttgctggagatcgtcaacgcgggaatcttgcgtcaactgagtaatcgtctggtggctgtcaaaacggaagtgacaaaccagttgattggtttctgccagcttaaccatttgcggaagagtcagtgccgctaacgttgtcgccatttcttcatttatgccgagacgaaacatagcggacgctttgtcctgaacaatcaaacgctgtgcaagtagtaaatatgacaagttgatgtcataaatgtgtttcagcaactcggaggtatgcattattcccacccagaataaccaactttatttttatgcggtttcaccgcaccccgtgatgtcgccgggaagccccggtaaaaaataattagcattagaatagttgcgataagctgcaataagcagaaccacctttttggtttaatatgtccttacaaatagaaatgggtctttacacttatctaagatttttcctaaatcgacgcaactgtactcgtcactacacgcacatacaacggaggggggctgcgattttcaataatgcgtgatgcagatcacacaaaacactcaattacttaacataaatgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccataaatgtataagtcatacttttgttttgggtgtatttcaatctgttaaaaagtttttcgctacgctagcaagcaaaaatgaaacaggaataatcgaaatgggatgttgcgcacagtcaaaataactcaccgtaaataatcatctgctataaataatcactttcatgcaataccagataagctatttttaaacagacacttaccgcacaacaaactaattaaatacaaagaaaggcaacaatcaacttaatgttaatgaaatgttttacatatattaaccacttgtttaatgcggagaatcagtacactattttcttataattacatttgaaattatatgatcaccgggagtgattgattaattatctttactaataatcagactaatatttacctgtttgaccgagttgggattgcgtcgtttctccattaggagtaaagctttaatgtcacctgaagttcacagaataaggaacaggttatgagctatagcaatattcttgtcgctgttgcggttacaccggaaagtcagcaactgctggcaaaagcggtatctatcgccaggccagtaaagggacacatcagtttaattactctcgcttccgacccggaaatgtacaatcaattagctgcgccgatgcttgaagatttacgcagcgtgatgcatgaagaaacgcaaagctttcttgataagttaattcaggatgcggggtatcccgttgacaagacgtttattgcctacggtgagttaagcgaacatattctggaagtatgtcacaagcatcatttcgatttggtgatttgcggtaatcacaatcacagtttcttttcgcgagcatcctgctcggcgaaaagagttattgcctcaagtgaggtcgatgtgctgttagttccacttacgggagattaaccgctcctacgcaagctttggaaaggtagcaactttatcgcgctgctggctttccgcgcttcgcggaactatctgctttaggtcgctaatgaagcactcctgccagtggttaatatcgtttttcacgataacgtccagcatttctgcatgacgggaaatacgttccgccagcgacatagtcaatgcacgatccagcgcagctgcaacttcgtcacgatcgtaggggttaacaattaacgccgacgttaactcgtttgccgctcccgcaaattgcgaaagaacaagaacgcccggattggctgggtcctgagcagcaacatactcttttgctaccaggttcatcccgtcacgcagtggcgtcactaagcccacgtcagagtagcggaatattttcatcagtaatttacggtcaaaatgctgattcaaataataaagcggcgtccagcctaattgcccgtatttaccattaattcgtccagcttcattttcgagctgatgacgaatatcctgataggcttgcacatcaccacgcgacgttggtgcaatctgggtataacgaattttaccatgatgctgcggatatttttccagcaacgcttcataggcgagaaaacgctctggcaaacctttggaataatccagccgttcgacagaaaagatattttgtacgtttttcagttccgctttaagttgcgccagttttggcggcagtggcccggcagcctgtttggctatttctttcggttcaatgccgatcgggtagacttctgttcgaaatgctttgccccaggctgtatggctttttgcgctacgtgtcgtgacgcgggtcaggttagaaagacaatccaggaacgccagacgatcgttttctgtctggaaacccagcaaatcataatcacaaagctgttcaagcaaggtgtcatatgtcggcagcgcgttgaagatttccggtgtcgggaaaggaatatgcagaaagaaaccaatgcgattattcactccccgtttgcgtaattcatgcgcaaatggcaacaggtgataatcgtggatccagataatgtcatcgtcttgcaacagcggcagtaatttatctgccagcaacgcatttacgcgtagatagccgtcccaggcaggacgctgaaattgcaccagatcgagccgataatgaaaagcgggccagagaacggcattggagaattggttgtagtattcgtcaaggtcctgttcgctgaggttaaaagaggcccacgtaatgttaccttttttcaccttttttagcggctgatcctcattccctgtttcaccactccagccaaaccacagtccgcctgcggctttcagtgcccccagtatgccaacggcaaggccaccggcactggcggcgtgctcgtctggtggtgcaatccggttagatactacgactaaacgactcatagtcatcactcctgttattttctcttttttgttgtaatgcggtggttatcatttcaagccagctccagacatccggcacacccgccagtcgccatgatgcctgagttgcacctgtgccaatttttactgacattccgcccagtcggttaacgactgcgaagccagattcatcggttaaatcatcgcccagaaatacgggcgttcgcccgataaagggagcttcctgcataaaagctgcaattgcctcacctttactggtacctctcggtttgatctcgacaacacactttccctgctgtaacgccatttgtggccagatctgagtaatacgttgcgctaatgtcattaatgcgtcttcatgctgcggagcctgacgataatgcagcgcaaaagccatccctttcgcctccagctccgcgccgggatactgagcgatgactgtatgcagttgcacgctaatatcacgcgcaatcgcatccggcagatgaacgatatgtgttttaccattgatgtcacggcgctccgccccatgcacgcccgctaacgggaagcgataaggttttgccagtgcgtcaagctccaccattgagcgccctgatatcaatgccaatgcaccatcacttgcggttgccagtagctgtagtccttgcagaatattgtcaggcacgacgacctgatcgggatgcggtttgatttccgccagcgttccatcaagatcaaaaaaccaggcatatttcgcggatagttcaggggtttcggttaacggttctgtcacccggttctcctccttctcttttcttattgtgttgcgcagaacgcgctttacagacatgtaagtatagacagtgtgacgggggtcgccatttgcaacgaagaacagccaaccgttatggcggttggctatggtgggaaaaaacgctaaattgttgcagaaaaaagcatcagacagtgcgtttcgctttttgcttgtaacggtcgaagatcaccgctgccagcaggattaagccgcgaaccacgtactgcgcgaaaggagaaatattaagcaggttcatggcgttttccacggtgcctaaaattaagatacccgccaccacatatgagatttttccgatgccacctttcagagaaacgccacctaaaacgcaggcggagataacaatcagctcataaccaatcgacgtcattggctgcccactggtcatacgtgaagccagaataattccggctatcgctgataccaggcctgagagaacaaagataataattttggtgcgaacaaccggtacacccgccagacgcgcggcctcttcgttcccgccaatcgccagggtgttacgaccaaaggtggttttattcagcagcaaaccaaagataatcagacacgcgacggtgagccagattggcgcaggcagaccgaaccagttggcgtaaccaagggcaaagaagctttcatcttcgataccgaccgctttaccgtctgaaatgatgtacgccagacctcgaacaatctgcatcgttgccaatgtcgtgatcagagcatttattttcagtttggcgataacaaagccattgaccaggccacagagaacgcccagcaacaaccccgctgccacgccaatccacaggctttcagtcaggttaataaccaccgccgtggtgacacccgcacaggcaattacggaggcgacagaaaggtcaaagtcaccggaagcgaggcagaacaacatgccacaagccaccatccccgacatggaaattgccaggcccaaccctttcatattaatgaaggtggcaaaatttgggacaaaaatggcacaggcgataaagagcaccgcaaacaccaccagcatgccgtactgatcccagatacgcccgaagctgaatgacgacttaggtgcgccagaccccgatgtagaaacagaagacatcatactctccttactcaggcaacagcctggctgactttaggcatcgcaaggctcagtgcctgacgctcatctgcctgctcgtgtaacaattcaccggcgatttcaccttcccgcatcaccacaatccggtcggcaacgccgaggacttcaggtaagtcgctggaggcaaacagcaccgccacgccctgcgccgccagcgcataaattacgttatatatttcgtgcttagcgccaacatcaatgccgcgcgtaggttcatccagcaaaatgaccttcatctcttccgataaccagcggcccagaatggctttttgctgatttccgcctgagagattcatgatcagttgctccgcgcccggcgttttgatgttgagcgaacgaatgtggtgatcggcattgttttcttcccaaccgttgttgattacacaaccgccgagcacatgtttacgtctggcactgatgttgatattgtcgcgaacggagtgcacgggaataatgccttccgctttgcgatcttccgggcagagcatcatgcctgcggcaatggcgtggctcggtttacgaatatcgatcggctgttggtcgatataaacctgaccggcggtgatttgcgtcccgccaaacatgcctttcattaattcgctacgccccgcccctaccagaccaaacagcccaacaatttcaccactgcgaaccgccagacttattggcgtacgcacgcctggtgctttcacagcatcaagacgtaggcgctcctcgccataactacgcggttgccagccgtagatatcgccaatgtcgcgcccgaccatcgcctgcaccagcgcgtcgtggtcaacctgctgcatatcggtaaaggttttgacataacgtccatctttaaagacagtaatggcatcgctgagggcaaatatttcttccatacggtgagaaacgtataagattacccgcccctcttttcgcagttcacgaataacgcggaaaagattgtcgatttcacgggcagagagggagctggttggctcatcaaaggcgataattttggcgttacgcgccagcgctttggcgatttcaaccatctgccactgaccaatggagagatatttcagcggcgtgtccgggtcaatatccataccaagatgtttaagttgtaaacccgcctcataattcagcaatgagcgattcacaatgccgcctttatgcggcagctggccgagatagatgttttccgcgacggtcatttccggcacgagatgcagttcctggtaaataatcgccacgcccgcgttaagtgctgcggtcgtgtcggaaaaggacatttcctgcccattaatcactacagaacccgtggttggcgcatagttgccgctgaggatttttaagagagttgattttcctgcgccattttcacccatcaacgcatgaacctgaccggcatagcagtcaaaactaatatccgtcagcgccttaacgccgggaaacgttttaccgatgccgcgaaatgagagatacggggtagactgttgcataacgtctccgtgaatcactggtcgttcacaccccctctgcatcatgcagaggggaatttttccggcaaattacttaccgcctaaaccttttttctccagttcttctttaaagttgtcacgcgtgatcagtaccacgtcggtaacttcggtaaattttggcggttcaacgtcttttgctacccagttgtaaagcatttcgctggatttatagccatgtacgtccgggcttggcagcagggaaccgtagaagccggttgcctgtgctttagacagttcgctcaccgcatccacaccgttaatgccaatgccgatgatatcggccgctttaaagccctgaccttccgtcgcgcgtacgccgcccagcacggtgctgtcgttcataccgacgatcagccaatgtttaacttccggatgttgaaccagcattgagttggcagcgtcaaatgcccccgggatgtcgttagatttggtaggtacctgataaatttgtttttccgggaatccggccgctttcagcgcatccatagatcccgtagtacggcggcgggcggtatccagttcgttggcggtaatcgccatcaccgcgctttctttgacatcccagccacgtttctgcatctctttatacagttcctggccctgacgttcgccaattttagtcgccgccatcatcaccagcggaacggtatccattggcttacctttggcgttaacaaactggtcatccacggcaatgactttcatatcgtagccacgcgctttcgcgacgatggcagagccgagtttggggtccggagtacaaataacgaaaccttttgcgccactggcagccaggctgtcgatcgcgttcaatgttttttcgccatccggcacggcaatcttaataacctcaaaccctaaatccttcccggctttatcggcaaacttccattcggtctggaaccacggctcttccggttgcttcaccagaaaaccgagcttcaggttctccgccatagcggattgtgacataacggctgccagaccaatggctgccagggctttagtaaatttgtgcatggttctctccagctttagtgtcgttttgtgtagggcaaaaacgaatgacattcgttaaattaatcggaaaacaaagcattaccttttaactaaaagataagtgactgtgttgacatagttttagcgagaaattaattctccataggagagcaatatcacatcgcagaattacagtgagaacgtgcataaatttagcgggaaaagacataagggaaagccaatttgtcagacaaattgtcgaatgcacagcagattaatccataagattagcctggaaatccttgttgtctttggtacccatgcgggatgtcttctttttaaccagtcaataggccgcattacctggcgttgagtttttgaaatggtgtaataaccgcaactcaaagatgtggaaaatgcacgtcattcatttcgtcattaattatcactgtgctcattaattaacagaacacgtataatgagagccatctcgcaaaaatgaaaaaacgttttataaaatcatcacttcatcatgaattcaaattcattgattaatatcaacaagatacaaaaagcactatcattaaaattcattgcagttacattgatttcatcaatgaaatgtaaaaatatataaacttgatgatttaagcattttcttatacccgttcagacgttattcttatttcagatcatcgtcagaattgactccacgatcacatttcggaccggcagaaaggaattattctgcaaacagtaattatggtgttttgatttatcttgcacctctccacttctggatataaggatattaggtatggcaaccgctggaatgcttctcaaactcaactctcaaatgaaccgcgagttttacgcatccaatctctaccttcacctgagtaactggtgttctgaacagagtctgaacggcaccgccactttccttcgcgcccaggcacagagtaatgtgacccaaatgatgcgcatgtttaactttatgaagagtgtcggcgctacccccatcgttaaagccattgatgttcccggtgaaaaactgaactctctggaagaactgttccaaaaaacgatggaagaatacgagcaacgttctagtacgttggcacagttagccgatgaagcgaaagaactgaatgatgattcaaccgtcaatttcctgcgcgatctggaaaaagaacagcagcatgatggtctgttgctgcaaaccattcttgatgaagtgcgcagtgcgaaacttgcgggtatgtgccctgtgcagaccgaccaacatgttctgaatgtcgtgtcacaccagctgcattgatcatcatcggcgctaatgcattgcgccgatgaaggttttgagaaaccgctgcctcatctgtttgaagcagcggtttttttaatgggattcaccctgtggggtaaacttgagttcaataagcgcgatggctttttggattgcccgcatggtgaccgggtctgcggcggcgggatggttagtaaagtcgatattcttcagctgactggacattttttcacgaacttcaacgggcgcgattacatcgagaacatccagaatttgtttgataaccaactggcaagcaaccacatcagaaaccaattcctgatcggcattcagcggctgggacatcgtaaactcctgatagcattttgaaagccgttatagtagcgacttcacatcttcagcgatagtcacatccaccgtcatcaggacacaaaaaaacctgccggagcaggttttttgttatcggaacatattgcctggcggtacgtctttgaacgtcttgcaatagttattgaacatacttttcaggattttgcgcagtttcatcgcggcactccgaccatttgttatacaggtgttattgtctttgcgcttataatatgacaaccatcacaaaaatcaatctttatgtgatacaaatcacataaatacccctttaatgttataaaaatgataatcaaaaaacagcccccctatttctgacacctacagatggcaagaaatagcgcctgccaggcgtcttttccggccattgtcgcagcactgtaacgcgtaaaatagtgctttctcttactcttctggctggaccatgagacttctgattctgactctttcattaataacgctggcggggtgtacggttactcgccaagcccatgtgagcgaagttgacgcggcaacaggtattgtacggttagtttatgaccaggcttttttgcagcatgcccataccgatcgttatgtcagtcgcgggatcgccgatcgcgcatgccagcaggaaggctatacccacgcggtcccctttggtcagccagtaggcaactgtagcctttttgcgggttccttatgtttgaatacggaattcactttgtcatatcagtgccatcattccgccttccctgtctttctctaaatattttaatcagcgaggggatcttcgctgattaaagaaatagcggtaatgcgttttattcccattcgtatttttaataattgaagtttatattttaccttttgcaaataataaaataacaaattatagtgacgccacagcaacaaatataacctttgtggagcactatcatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaatgctctccggcggcaggtttactgccgccgtttcaaatcagtgacggcaaatcttactctgatcggtcgaaaaaccgtctttcgaaggtataaatttgccttttgctgccagaaacgctaccagctctcccgctgtcatcccttctgccgagcaggtgtgaaaacgtgcctgttcaccaaaacgcgctttaatcgcagcttccagactggcatgcgtatattgctcgcctgattcaatcatcatatttaacacttcatgaccgtgaatagagtccatcgtccctcctcaaaaaaagcctagcgtagcgattgccgcttatgaagactttgcgccagcgcaggactgaatgctttttattgtacatttatatttacaccatatgtaacgtcggtttgacgaagcagccgttatgccttaacctgcgccgcagatatcactcataaagatcgtcaggacagaagaaagcgtgaaaaacagaaccctgggaagtgtttttatcgtggcgggaaccacaattggcgcaggcatgctggcaatgccgctggctgcggccggtgttggttttagcgttacgttaatcttgttgattgggctttgggcgttgatgtgctacacggcgctattactgctggaggtgtaccagcatgttccggcagataccggtctgggcacgctggcaaaacgctatctgggacgctacggtcaatggctgacgggcttcagtatgatgttcttaatgtatgctctgactgcggcatacatcagcggtgccggtgaattgttggcctccagcatcagcgactggacaggtatttctatgtcggcaaccgctggcgtgctgttgttcacttttgttgccggtggcgtggtttgtgtcggaacttcactggtcgatttatttaaccgttttctgttcagcgccaagattatttttctggtggtaatgctggtactactgctgccgcatattcacaaagtgaatcttttaaccctgccgttgcaacaggggctggctctgtctgcaatcccggtgatttttacgtcgtttggttttcacggtagcgtgccgagtattgtcagctatatggatggcaacattcgtaagctacgctgggtgtttataatcggtagtgcgatccccctggtggcatatattttctggcaggtggcgacgcttggcagcattgattcaacaacctttatgggattgctggctaatcatgctggattaaacgggctgttacaggcgttacgcgaaatggtggcctctccgcatgttgagctggcagtgcatttatttgctgatttagccctcgccacgtcatttctcggcgttgcgttaggcttatttgattatctggctgatttatttcagcgttcaaataccgttggtggacggttgcaaactggtgcaattacgtttctgccgccgttggcgtttgcactgttttatccacgaggatttgtgatggcgctgggttacgccggtgtggcgctggcggtactggcattgattatcccttcgctgttgacctggcaaagcagaaagcacaatcctcaggcgggttaccgggtcaaaggtggtcgtccggcgctggtggtggtgtttctctgtggtattgctgtgattggcgtgcaatttttgattgcggcagggttgttaccagaagtggggtgatcagatagcctcaaattccttattgggtgccagaattaacgctgacacccaatttggcctcttaatgcaggcagcactgcttaaatttcttaccactaccgcacgggcaaggatcgttacgccccggtttctcttctgctttgatcggttgctgaacagctttttcctgcggatgcgccatccagtacgcatgtagatcaagcgccgccagtcgaatggcatctacgctctcttcaaacgcttctggcgacatcttttctacccgctcgaagttttcctcagtaccgtgcagcgcaatcgcctccagcgctggttttaacgaatcgggcaacgttgaccagtcagaaagtgccacgccccgcatatagccaaagcaccactcctcaacaatcgtcagctcgctgccatcaacttctcgcaagccgaataacggctcaaactgctccgggaattcgttcagacgctctgcggtatcggccatatgttgaaaagccagattcataaagcgcgtcatctctttctctgacgcccagcgcggcacatagtcagccccaccccacacggcaaccagccactgttccggttcaatctcttgcggagaactcaacaccgccgtcaataaaccgtccagctccgccacatcaaggatggcgtggtcagtgttgtatttggtcagaatatcgtccagccattccaactcactttcgtttaacggtcccgttttcatacgcttttccttgtggatctcaactcgccagcacctatcttacatgccggtccgtatcagagatactttttgagtggctttgctggtgattaaaaattaaggagggtgtaacgacaagttgcaggcacaaaaaaaccacccgaaggtggtttcacgacactgcttattgctttgattttattcttatctttcccatggtacccggagcgggacttgaacccgcacagcgcgaacgccgagggattttaaatcccttgtgtctaccgattccaccatccgggctcgggaagaaagtggaggcgcgttccggagtcgaaccggactagacggatttgcaatccgctacataaccgctttgttaacgcgccaaattcttcaggcctttcagccagacatccgcttgacgccgatgtcttttaaactggagcgggaaacgagactcgaactcgcgaccccgaccttggcaaggtcgtgctctaccaactgagctattcccgcattcatcaagcaatcagttaatcacttgattttattatcgtctggcaatcagtgccgccgttcgatgcgttgcattctacttacctggcgcgatgagtcaacgatatttttcaccacttttgatcgtttgctgaaaattacgccgaaacgatcactgatcaagcaaatctgcacgcgcagcgctcaaatattgcaacattgaccacagagtcagtaccgcagccacaaagaaaagtgcaataccggcgtactcaacccaaatgttcggacgccacagcagccatgccaacgccaccatctgggcagtggttttcactttcccaatccaggagacggccacgctactgcgtttacccaactccgccatccattcgcgtagcgcagaaataataatttcacgggcgatcatcgttgccgccggtaatgtcacccaccagctgtgataatgctcggttaccagcaccatggcgatagccacgagaactttatctgccacagggtcaaggaaagcaccaaaccgggtactctggttccagcggcgtgccagaaaaccatcgaaccagtcagtcaccgccgcgacgcagaaaatgagcgcggcggcaaacggcgaccaggtgacaggcagataaaagaccaatacaaagaatgggataaggatgacacggaacagtgtaagcaacgtagggatattaaattgcataatgacgggtaactatctgttgtcagtaagattacccctatgttgctacagagacatcaatgtttcaacgaccagaagatcttttctgccagaccttgcgaaatacccggcacttttgcaatttcctcgacgctggcgttacgtaaaccttgcaaaccgcccatatatttcaacaacatttgccgacgttttggcccgacgccttcaatggtttccagggaactggtatttttgaccttcgcccgttttttacggtgcccgccaatcgcgtgatcatgtgattcatcgcgaatatgctggataacatgcagcgcgggtgaatctggcggcaaactaaatccctcaccttccggctcaaagaacagcgtttccagtccagccttacgatctgctcctttggcaacgccaagtagcagcggatgatttttatcccatgagacatccagttcggcgaagacatttttcgcctgcgcaagctggcctttgccgccgtcgataaggatcacatccgggatcttactgtcgtcaatggctttaccataacgccgacgcagcacctgattcatcgccgcataatcatcgcccggcgtgatgcctgtaatgttatagcgccgatactccgcacgcagcgggccgttagcatcaaacaccacacaggaagcgacggtttgttcgcccatggtatggctgatgtcaaagcactccatccgcttcacttccggcaatttcaacacgctggcaagcgcggtcagtcgctggtgaacggtagattgctgcgaaagtttgctggttaaggccgtcgccgcattggtgcgcgcgagtttcagataacgcgccctatcgccgcgaggtttggtttgaacattaatcttgcgtcccgccagttctgaaagggaatcggcgagcagcgttttatcgctaagattaaaatcgagcaggatctcacccggtaaggtgcgcatctggctgccttgtaaatagaactggcctacgaaggtttctaccacctcgctcagttccgtaccgccaggcactttcgggaaatagctgcggctgccgagcactttgccctgacgaatgaacaatacgtggacacaagccatgcccgcatcgaacgccacaccaataacgtcgaggtcgtcgccggtattggaaacgaattgtttttcggtgacgcgtcgcaccgcctgaatttggtcgcgaatacgtgcagcttcttcaaactccagattctggctggcagtttccatacgactaatgagttgcgtaagcacctgatcatctttgccagacaaaaacaggcgcacatactcgacctgctgagcgtattcttcttcactcaccagtccttcaacgcacggtcccagacagcgccctatctggtattgcagacacggacgcgagcgattgcgataaacactattttcgcactggcgaatggggaaaatcttttgcagtagcgccagtgtttcacgtacggcatagccattcgggaacgggccgaaatattcacctttggcatgcttcgcaccacgatgcatcgccagacgcgggtgggtatcaccactcaggaagataaaaggatatgatttatcatcgcgtagcaaaacgttgtaacgcggctgatagagtttgatgtagttgtgttccagcaacagcgcttcggtttctgtgtgagtaaccgttacatcaatttgctggatctgggcgaccagcgcttcggttttgcgcgaagcgaggttgctacggaaatagctggaaagccgttttttcaggtctttcgctttgccgacatagataaccgtaccaccagcatcgtacatgcgataaacgcctggctggctggttacggtttttaaaaacgcttttgcgtcaaactgatcactcactgacttgataatgtctccgcattacacagaccatggcgaattgccaggtgagtcagctcaacatcgccatgaatgtttagtttactgaacatacgatagcggtagctgttcaccgttttcggactgagattgagctgttctgagatctcattgaccttctggcccttggtgatcatcagcataatctgcaattcacgttcagacaaactggcaaatgggctttctgttttttctggttcgatctggcttaacgccatttgttgagcgatgtcagaagcaatgtaacgctgccctgaatagacagaacgaatcgcactcacgacttcctgcggagccgcgcctttgctgaggtagcccgcagcaccggcctgcatgactttcgctggtaaagggttttctgtatggacggtaagcatgatgattttgacatcagctgtggaacgcgcgattttacgcgtcgcctcaagaccgccaatgcccggcatactcatgtccattagcaccacgtcaacggcatttgtccggcaccacttaacggcgtcttcaccgcacgatgcctcaccgacgacttttataccctttatatcttccagaatgcgtcgtatccctgcgcgcaccagttcgtggtcatcaacaagtagaacgttgatcaaaggaatatctccagaaatagggataacgctactgatagttagtcattcgtatattagcggtttttattgcaactttgaaacgttaaaaatggtgggtattcgatttttctctcgtttttgtcaattcgattgtccacagttatggtcacgcccgtcaccaacggcttaccggatcgtttcacagtaagccctacgatgaaatgtgacaaaaattgactttattcagcaaaaatgaaaatcagcccgctgaatatgtaacattaattaacccgaacaatacgggcaaaaaacattcatgataaaaatatttattggtcattatattaacgtattttatagcactgccgatatcacgctcaaaaaacaaccactgctatttttagcaaagcttatggtatactccgccgccttaacatttttcaccgcaaattttcattgcaacatgacgaggaaaataaatgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaatataaaaccggctgatagcgtgcctttcagccggtttttgcatctggcacgcaggacagaaaagagatcaaattaagccagtagcggccgcgtaacaggcaacctgggtcttatttggtgcattaatttttttctgcatgtttttctggtggaaattgaccgtattctcagagattgacaaaatcatcgctatctctgctgatgttttcccttccgccgtccacctcagaatttctttttcgcgcttgctgaaattcatctctggcgtcatcactatttcatcatttaaacgcatcagagccatcagactttcgcgcaccagtaactgcatttttaattgcagttcatcactaagaatgggtatttcgcgcgcgctgcaacgggaaaaggacaaaaagcccagcgcccggtttggcagcattaaatactgagtgacaccgcggcgtaaaccatgtgcgcgcgcggcttcccataacggctgtgcttcgctgaataagtcatcattccacattaaatggccctgactaaagttttcagggttcagcaccggatcaattgcgagaaagttttttgcctgataataactaacccacgcctcagggtaattggtgtaaaaagccactttaggtcgagtgaatggtaccgggtggcggacacataacgaatagtaatcgtactccagctgctgagcctgaagctcaatttcatggtagacctcttctgcggtctccatcctctgaaaacgcaacagcatcgtgcgacgccagctgaaaaaatccttatcctgcatagtaaaccgcaacgcccctgagagtgagtatcatttataatgataattcaaactatcacataaataagatttatatataatttatattattcaggcaatgaattacttttgcaagccatcgcattctcttatgttattaatgagttatgctgatttgttaagcagttttatcaggcttgaaatggcgtccagccccgacaggtgaatcgtcggggctgattttttcttattattgcagcagaaacttctcgaggaactggcgggtgcgaggctgctcggggtcggcaaataacgcttttgcggccccctgctcgactatccgcccctggtccataaagatcgcccggtccgcaacatcccgggcaaagctcatttcgtgcgtcacaatcaccatcgtgcgcttttcctgcgccagctgacggatggtgttcaggacttcacccaccagctctggatccagcgctgacgttggctcgtcaaacaaaatcacctcaggacgcattgccagcgcacgcgcaatcgcaacacgctgctgttgaccgccagacaaacgacgtggatagctggtttctttacctgccagcccaacttttgccagcagctcgcgagcgcgcgccgtggcctcttctttcggttcacctttgacgatcaccggcccttcaataatgttctccagcaccgtacgatgcggaaacaaattaaagttctggaagacaaacccgacgtgctgacgcaactggcgaatcagagatttttgctgacttaatgaacgtgcagtatcaatagtgatatcgccaacggtgatcgttcccgcttcgggttgttccagcagatttatgctgcgtagcaacgtggttttgccggaaccactcggaccgataattgccaccacttcgccaggctttacctcaaggtcgataccgtgcagcaccgtctgaccgtggaattttttcaccaggttcttaacttcaatggcactcattttggttctctctcctggcgattaagttgattctcaaaatggttctgcaacgtcgataacacagtcgccatgatccagtagatgagcgaagccgccagatacatggtgaacacctccagcgtacgcgaggtaatcaactgcgcctgacggaacagctccggcacctggattgtcgcggccagcgacgtatcttttaccaggctaataaagctgttcgacagcggcggcaacgccacacgcgccgcctgtggcaaaatcgcgcgacgcatggtctgccacggcgtcataccaatactggctgccgcttcccactgacctttatcaatagaagaaatggcggcgcgcagcgtttcggcagcataggcggcagtgttcaacgacagaccaatcattgctgacggaatgggatctaattcgataccaaactgcggcaggccgtaatagatcataaacagttgtgcgatgagcggcgtaccacgaaaaatagagatataaaaacgcgccagccagcgcacgggccagattggcgacagacgcatcagcgcgagaataaacccgagcagtaagccaaaaaacatgccgccgatactgagttgcagcgtatacccagcccctttcagcaggaacggcaaggaatcaataaccagttgtatactttcttgcatgagcgtttccggagctaaacgtggggatgataggcgaacagcgcaggcgcaccgccggtatgaataaacagaatcggcccttcatctttgaagcgtttctgactgataccgtcaatcagccccgccatcgcttttccggtatacacaggatcaagcagaatgccttccagccgcgccagcaatttcactgcttccatgccttcgtcgttcggcacgccgtagccaggtgcaaaatagtcatcccagagtaaaatttccgctgatgcggtcagctccagttctttcgcaatcgcctgttgtaggttaaccactttcggcaattgatcggcaacggaacgcgacacggtcacgccaatcagttcgctttcaggcatcaggtgttccagcccaacagccagtccggcgtgagttccggcactgcccgatgcgactaccaccgatgaaatattaaccgccccttcacactgttgcgcgatttccagcgcactctccacataacctagcgcgccaagagcattagaaccgccaaccggaatgacatacgggcgaaagccttgtgcttcgactcgcgtcgccagctcttccagttgggcattgggatcggtcagtgcgtcgcacatttcaatctgggtattgaacagatccagcaacaagcgattgccgttggttaaatagttttctgcggttgtgccaataggattttccagcagcgccacgcagtgcagaccgagtttggcagcgactgcggcagtctgccgcacatggttagactggatcgccccggcagtaatcagcgtatcggcaccttcacgcagagcatctgccgcgagaaattccagcttacgtaatttattgccgcccattgccatgggggtgacgtcatcccgtttgatgaaaatttcccgtcctagataatcagaaaagcgcggcagatattcgagcggcgttggcgcgccgataaactccagccgtggaaaacgggttaaattatgcagtggcataacagcctccgatgtgtgttgttgtgattttcttattatgcacgctgaaaacgcgtaaataaaaaaggcgctagtgaaagcgcccttttttgtcattatgctgattatttggtcacatcagcaccaaaccatttttcggaaagggcttgcagagtgccatctttttgcatttccgcaattgcatcattcactgctttcagcaggtcctcatttcctttacgcagcgccacgccagactcctgacgggagaatgcttcaccggttactgccagcgtatcgttggttttcttcaccagatccagcgccgccagacgatcaacgaggatcgcatcgatacgccctacgcgcagatcctgatatttggtcgggtcatcatcataggtacgcacatcgacgccctgaacattctgccgcagccactcttcatagttggtgcccagaccgacccccacttttttgcctttcagatcatcggctgttttaatggtgccttcgttaccttttttcaccagcgcctgaataccagaaatggtgtacggggttgagaaatcgtattttttcttgcgctcatcagaaatggtgacctgattaatcaccacatcaatacgtttagagtccagcgacgccagcataccgtcccatttggtcggttttagtgacgcctcaacgccaagatgttttgccagctgttgggcaaattccacttcaaaaccggttaatttgccgtcatctccctgaaaactgaacggcggataagttccttccagccctaccagcagcgtgccgcgctctttaactttattaagcagaccttcatctgcaaaacttttaacgctcatgcccgcaaccagcgccacggccatcacacccatcaatgcctgacgtcccagatgtgctaatttcatattcaccccgaatgttgttatgtctgtttgcagtgtagagccattgtttgtaaacacaaaaacaactccgctacatcttattcttatttaatatatatcagaagaaggcaggctggaggatttctgcacaagtctggtacaggtttggcgctgatagtgttgatacttccgtaacgcgatgcggtaattgttggtgctggtggtgggcagccacggggcgaggatttcatcaaggaaaccgtcctgcagctgatcgagggaaatattttgctcgtgtagatgattccccaaacggcgcaaacgaacgacatattcacgcaccgtacctgggctcatttcagtttgctcaaaaagaaattgcttaaagccgataatatcgaaaaaatcactctgcgttttgcaatgtaaatcaccgcaaaatcggcacaatgccgcccatgatttttgttccgtttgccagccattttcatcaagcagcgtgtccaggcgggaaatctcgattttattcactattttgccgtcgcgaactaaggtaatgcgatcgagtaatttacggcaatgcgcgcaatgggtctggctgtgtttaaagtctttaagatagcggcttaatggccgtcttttcaggtgctgcaccatcattaagaactcctggtagtcaaagttaaagtgcggcatttactgacgttataacttacccagtttagtgcgtaaccgtttaatagcctggctgtgtaactgactgacccgcgattccccgacctccagcaccgcgccaatctctttgagattcagctcttcctggtaatagagggttaataccagtttttcgcgctccggcaacgtttcgatggcttccatcacccgctggcgcagattactgtccagtagttgttgtagcgggttttctcgctgatgatcatcagtaaccagttcgatgctatcgccgtgctcttcgcgccactcatcgtaggagaagagctggctgttattggtgtcgagcaacatttggcgataatcggcaatatcgatccctaaacgttccgctacctcagtttccgtggcgttgcggccaagttcctgctccagttgccctattgcctgtgccacttcacgcgcgttgcgtcgcacgctgcgcggcacccagtcacggctgcgaagttcatccagcatagcgccacggatacgctgcactgcgtaagttgtaaatgccgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttacaggtaaattccaggcagaaaaaaaccccgccggtggcggggaagcacgttgctgacaaattgcgctttatgttgccggatgcggcgtaaacgccttatccggcctacaaaaatgtgcaaattcaataaattgcaattcaacttgtaggcctgataagcgcagcgcatcaggcaatttggcgttgccgtcagtctcagttaatcaggttacaacgattaaccctgcagcagagacagaacctgctgcggtacctggttagcttttgccaacacggagttaccggcctgctggatgatctgcgctttcgacatattggacacttcggtcgcatagtcggcgtcctgaatacgggactgcgcttcagacaggttggtagtggtgttgttcaggttggtaaccgcggaatccagacggttttgcaccgcaccgagggaagaacggaatttgtctacagatgcgatagcatcgtccagcgctttcagcggatccgtggttttaccatttgcaacagcagtcagagcctcaccaccagcagtcaaacctgtttgcagattaccgccatttaaatcggcagaatcgtatgttttaccatcaatatcgaccacttctgttttgccatcatctccgcccagtttgaccgcggttggagaactggcggcaccggaagagtcagtataggtaatagttttaacagaaacagcaccagtagtttcattcacatccgcagcgtaaagattgccatttgtatctttaagcgcatatgtatcggtatcattacccttggaatcctgcagttttactaagctaacagcaccaaggttggcagttgcggaacctgcagtattatcaatctgaacaggtgtaccgcctgaagtgatagttgtagctttagtagtatttgcatcagttacagttgcatttgccgttgctccagtcgccattgtcactgtaccatcattagcaactgttactgcgtaatacttcccatcgttatcaccaccggtgattttcgcatagtaatcattaccattatcagtataaacaccctcaattgaagctgggttagttccgccagtatcagtggctgcttccgtagaaagggtaattccagtaagtttaatattgtttgtggtggtagcaccaaaagcagttactggagcactagtggtaactgtatcgttatttttaacgctaaaaccatcaaggccaagagttttagcatcaatctgcttcagatcgatagtgatagtctggttatcatttgcgccaacctggattttcatggagccattttttgccagcacgttcacgccgttgaactgggtctgaccagatacgcggtcaatttcatccagacgggatttaatttcgtcctggatagaagacagatcagactcagagttagtaccggtagtggcctgtaccgtcagttcacgcacacgctgtaagttgttgttgatttcggacagcgcgccttcggtggtctgcgcaacggagataccgtcgttggcgttacgggccgcctgagtcaggcctttaatgttagaggtgaaacggttagcaatcgcctgacccgctgcgtcatccttcgcgctgttaatacgcaagccagaagacagacgctcgatagaactcgacagcgcagactggttcttgttgatattattttgagtgatcagcgagaggctgttggtattaatgacttgtgccatgattcgttatcctatattgcaagtcgttgattacgtattgggtttccacccgtcggctcaatcgccgtcaaccctgttatcgtctgtcgtaaaacaacctttagaatttttttcaaaaacagccattttttgttagtcgccgaaatactcttttctctgccccttattcccgctattaaaaaaaacaattaaacgtaaactttgcgcaattcagaccgataaccccggtattcgttttacgtgtcgaaagataaaaggaaatcgcatggcaagtatttcatcgctgggagtcgggtcaggtctggatttaagttccatccttgatagcctcaccgccgcgcaaaaagcgacgctaacccccatttcaaatcagcaatcgtcgtttaccgctaaacttagcgcctacggtacgctgaaaagcgcgctgacgactttccagaccgccaatactgcattgtctaaagccgatcttttttccgccaccagcaccaccagcagcaccaccgcgttcagtgccaccactgcgggtaacgccatcgccgggaaatacaccatcagcgtcacccatctggcgcaggcgcaaaccctgaccacgcgcaccaccagagacgatacgaaaacggcgatcgccaccagcgacagtaaactcaccattcaacaaggcggcgacaaagatccgattaccattgatatcagcgcggctaactcatcgttaagcgggatccgtgatgccatcaacaacgcaaaagcaggcgtaagcgcaagcatcattaacgtgggtaacggtgaatatcgtctgtcagtcacatcaaatgacaccggccttgataatgcgatgacactctcggtcagcggtgatgatgcgctacaaagttttatgggctatgacgccagtgccagcagcaacggtatggaggtctcggttgccgcccagaatgcgcagctgacagtcaacaacgtcgccatcgagaacagcagcaacaccatcagcgacgcgctggaaaacatcaccctgaacctgaacgatgtcaccacgggcaaccagacgctaaccatcactcaggacacctccaaagcgcaaacggcgattaaagactgggtgaatgcctacaactcgctaatagataccttcagcagcctgaccaaatacaccgccgtagatgcgggagctgatagccagagttctagcaatggtgcactgctcggcgactccacgctgcggacgattcagacgcagttgaaatcgatgctgagtaataccgtcagttcttccagctataaaacgttggcgcagattggtatcacgaccgatcccagcgatggcaaactggaactggatgccgacaaactcaccgctgcactgaaaaaagatgccagcggcgtaggtgcattgattgttggcgatggtaaaaaaaccggcatcacgaccaccatcggcagcaacctgaccagttggctttcgacaacgggcattattaaagccgctaccgatggcgttagtaagaccctgaataaattaactaaagactacaacgccgccagcgatcgcattgatgcgcaggtcgctcgctacaaagaacaatttacccaactggacgttttaatgacctcgttaaacagcaccagcagctacttaacgcagcagttcgaaaacaacagtaattccaagtaagcaatattcatcgggagacaggtcatgtacgcggcaaaaggcacccaggcctatgcacaaattggcgtcgaaagcgccgtaatgagcgccagccagcagcagctggtcaccatgctatttgatggagtgctgagcgcactggttagagcgagcctgtttatgcaggacaacaatcagcaaggcaaaggcgtctctttgtcaaaagcgatcaacatcattgagaacggactgcgggtgagtcttgatgaagagagcaaagacgaactaacccaaaacttgattgctctttatagctatatggtcaggcgcttgctgcaagccaatttacgcaacgatgtctccgcagtcgaagaagtggaagcattaatgcgcaatattgccgatgcctggaaagagtcgttactctccccttctttgattcaggacccagtctgatgaaccatgcaccgcatttatatttcgcctggcaacaactcgtcgaaaaaagccagctcatgttacgcctggcaacggaagaacaatgggacgaactcatcgccagcgaaatggcgtatgtgaatgcggtgcaggagattgcacatttgactgaagaggttgacccgtccaccacgatgcaggagcagctccgcccgatgctgcgcctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttgaatctgaatgagtcgatggctcgcgaataatccgattacggctacgcttctaatgttccccttgaatggagtcgaagaatgcgtaatcccacgctgttacaatgttttcactggtattacccggaaggcggtaagctctggcctgaactggccgagcgcgccgacggttttaatgatattggtatcaatatggtctggttgccgcccgcctataaaggcgcatcgggcgggtattcggtcggctacgactcctatgatttatttgatttaggcgagtttgatcagaaaggcagcatccctactaaatatggcgataaagcacaactgctggccgccattgatgctctgaaacgtaatgacattgcggtgctgttggatgtggtagtcaaccacaaaatgggcgcggatgaaaaagaagctattcgcgtgcagcgtgtaaatgctgatgaccgtacgcaaattgacgaagaaatcattgagtgtgaaggctggacgcgttacaccttccccgcccgtgccgggcaatactcgcagtttatctgggatttcaaatgttttagcggtatcgaccatatcgaaaaccctgacgaagatggcatttttaaaattgttaacgactacaccggcgaaggctggaacgatcaggttgatgatgaattaggtaatttcgattatctgatgggcgagaatatcgattttcgcaatcatgccgtgacggaagagattaaatactgggcgcgctgggtgatggaacaaacgcaatgcgacggttttcgtcttgatgcggtcaaacatattccagcctggttttataaagagtggatcgaacacgtacaggaagttgcgccaaagccgctgtttattgtggcggagtactggtcgcatgaagttgataagctgcaaacgtatattgatcaggtggaaggcaaaaccatgctgtttgatgcgccgctgcagatgaaattccatgaagcatcgcgcatggggcgcgactacgacatgacgcagattttcacgggtacattagtggaagccgatcctttccacgccgtgacgctcgttgccaatcacgacacccaaccgttgcaagccctcgaagcgccggtcgaaccgtggtttaaaccgctggcgtatgccttaattttgttgcgggaaaatggcgttccttcggtattctatccggacctctacggtgcgcattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagccgcagtggcaccgacgaatttcccggctgcgtggtggtcatgtcgaacggggatgatggcgaaaaaaccattcatctgggagagaattacggcaataaaacctggcgtgattttctggggaaccggcaagagagagtagtgaccgacgaaaacggcgaagcaaccttcttttgcaacggcggcagcgtcagcgtgtgggttatcgaagaggtgatttaaattcatccccggcggcaagccggggagatttcattacggcagtggcgtcggtaacggcgctttatccagcgcggcggcacactctgctgtcgggcgatccacacgctccatcgtcataccatcgtactcaatggtgttaccgtcacgctcaacctcgtacagctcacgttttacggtaacgttagtgagatcatcagacatcaatgtcaacttacccggcacggcaatcacccgctgccactgacggcaatccagggtatcgccctctttagtgacaatcaggctgcctatcgcttccgggctgaccagcgcacgttgcggccctttggtctgccagtagcccgccagccagtccggcgcgggggttttcacgacattgttatagttttcgacttcggcacagcccgccagcaacaagagcgcgcctgcaattgcgagttttttcatcattcgtcctgcatgagaagaaaagaggattgtggcattaaagccctgatgtcgccagcctttcaaggttcagagagaaatttgatctaactattatttttgtgaattattaccccgaaaataaatttgcatggtgtatgattcgcgactcttgtttcaaaccttctgagttcagaggctacattcatgtcatggcagcaattcaaacacgcctggttgattaaattctgggcccccatccctgcggtcatcgcggcgggtattctctctacttactattttggcattactggcaccttttgggctgtcacgggtgaatttacccgttggggcggccagctcctgcaactgttcggcgtccatgctgaagagtggggttactttaaaattatccatctggaaggatcgccattaacccgcatcgacgggatgatgatcctcggtatgtttggcggctgctttgccgcagcgctgtgggccaacaatgtcaaactgcgaatgccgcgcagccgtatccgcattatgcaggccatcattggcggcattatcgccggttttggcgcgcgtctggcaatgggctgtaacctggcggcgttctttaccggtattcctcagttctcgctgcatgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacagcgatgaaccaacccaaactggggctggcaatgctgtttggcgtcggctttggtttactgattgaacgtgcgcaaatctgctttacttcagcgttccgcgatatgtggatcaccggacgtacccatatggcgaaagcaatcattatcggtatggcggtgagtgccatcgggatcttcagttacgtacagttaggcgttgaacccaaaatcatgtgggcgggaccaaacgcggtaattggtggtttactgtttggttttggcatcgtgctggctggcggctgcgaaaccggctggatgtaccgcgcggtagaaggccaggtgcactactggtgggtcggtctgggcaatgtgatcggctcaacgattctggcgtattactgggatgatttcgctccggcgctggccaccgactgggacaaaatcaacctgctgaaaacctttggtccgatgggtggcctgctggtgacatatttgctgttgtttgctgcgctgatgttgattatcggctgggaaaaacgcttcttccgccgtgcggcaccgcagactgctaaggagatcgcatgaaaaatatcgttcctgattaccgccttgatatggtgggtgaaccctgcccttatccggcagtcgcaacccttgaggcgatgccgcagttaaaaaaaggggaaatcctggaagtggtgagcgactgtccgcagtcgatcaataatattccactggatgcgcgtaatcacggctatacggtgctggatattcagcaagacgggccgaccattcgttatttaattcagaagtaatccctcattcccgctgtgacccacagcgggaacatcgttacctttgtatcacatagattttacccgcccccactcctattcttttcagtatgatctcaggaggtttctatgtgtggacgctttgcccaatcccaaacgcgtgaagattaccttgcgcttctcgcggaagatattgaacgcgatattccctatgatcccgaacccattggcagatacaacgtcgcgccgggaaccaaagtcctactgctcagtgaacgtgatgaacaccttcatctggatccggttttctggggatatgctcccggatggtgggataaaccgccgctgattaacgcccgcgtagaaactgcggcaaccagtcgtatgtttaaaccgctctggcaacatggtcgggcaatctgttttgccgatggctggtttgagtggaaaaaagaaggcgacaaaaaacagcctttttttatctatcgtgctgatggacaacctatttttatggccgcgataggtagcacaccatttgagcgtggtgacgaagccgaaggatttttgatcgtcactgctgcggcagatcaaggtctggtagatattcatgaccgccgcccactggtactgtcgccagaagctgcgcgggaatggatgcggcaagagattagcggtaaagaagcctcagaaatcgcggccagtggctgtgttccagcaaaccagttctcctggcacccggtatcgcgcgcggtgggtaatgttaaaaaccagggcgcggagttaattcaacctgtttgataagcctggagattattgatcaacaatactgcgtcataagaaatctctattagacaaagatttcattacctgttggcatattgcaaaaataacaccaatacggaatcgtcatgttcacgattaaaacagatgatctcacccatccagcagtgcaagcattagtggcttaccatatttccggcatgctgcagcagtctccccccgaaagcagtcatgctttagatgtgcaaaaattacgtaacccgacagtgacattctggtcagtatgggaaggcgaacaactcgcaggaattggtgcgctgaagttgctggatgataaacacggcgagctgaaatcaatgcgtaccgcgccaaattatttacgtcgtggtgtcgccagtctgattttacgccacattttgcaggtcgcccaggacagatgccttcatcgcctgagcttagaaacgggtacacaggctggatttacggcctgccatcaactttatttgaagcatggtttcgctgattgcgaaccgtttgctgattatcgacttgatccacacagtcgatttttatcattgacgctatgcgaaaataatgaattgccatgagccagacgcagcacattcttgcattcgacgtgctgcgcctttatttatcaccagcaggaaacgccttgtccatagacgccccttccacatgcgccacaagaaacctctattccagtgacacaattgcgcctaattaattacatttaatatttaattatgagttcctcaccatctattacatactttttaaccatatcggaatatttatcataatcagcgggattcgtaacaatatattttcgctgcgatctttcatagcaaatccctgtcaaagtccatgatataaaaatgtctcttcaaaagaattacattctttaaaaagtaattctttattgctatatatcgcagagacaacctcaatatcacactccatacgtgctttctccagatgatttgggaagtattgaatttcttttatcttattatcgccacaattaaacagcttagtagtctcaggcattgctggtatttaccatattttattgcgataaatagaaattgtcatagcctttgacggagatgagtcaacacgcgatatcagattattatctacggagacctgggtaattccatcggatacttttggaaataccatataattattgaaatcgagctctaattctttgcagaatttgggaatttgtattgtggcaaggccattatgacgaagataaagcacctcaatccaggatggaagaggtggcaaagaccccaagtgaagatctgttaagtcaagtttactattgtggagttcaacacatttaaacaatctcaccaatgctatatccacattttttttgaagtcattcgatgcgccttcttttactgaattagcccagtcgctgaaacctttgcaaagtctggaatctgtaattttcgtaaagttgtctagaaactctgcaatattagtcgatataaactctaatttatgccgaatgggtgggttaccagttccctgattttttctatcatgataaaacctatcttattataaatcgagaaatcttgaaaccagagactataatcaccccattcgaaatattctgagtgcaataacttaaattctgacagcatattaaataatttgctgtcttcactaattggtgtaaacttaccatttccaagacaactgactaactcacttgataattcatttatgattgcatcatcagatactaactcatgttgttttatcgtagattcagtattagatgtgactttatttaattgaaccggctgagtttttaacgaaagatcatttaatggaaacatttacactcctgtttaataaattatattgcccagggcgcattctaaaacacaataaaattaccactatcaaaaatcgctcatatccatcgcccggaatatgaataaaaacatcaacaaagattaaattatccagaggttactgttgcgtctgtggtcgtaacaacatccgacgtggtgatgtgtcaaatgagacgctctgatgttcaggggggttatcgcgtatacggatcgtggatggcagaaaacgttcaggatcaggtatccattttaaaccagaaattgagtgagtttgccccatccatgccccacgcggtgagatcggatgtaattaacaacaggttacaaaacctacacctgcatgctcatcacttcctgatacgccgccaccagcttattacgcacctgaatccccatttgcatagaaactgaggctttttgcatatcggtcatcacatcgtttaacgccacgccgggttcaccgagagtgaatttttctgcctgcgtgcgggcagctgtttgtgtatcactaatgcgatcgagcgcggcgtgcagctgcccggcaaaactaatggtcggttgcggcagtgattcctgcgcacgcgcactcatcgccgtagcctgtaactggctgataaccccttcaatcccctgtatcgctgacattctcgtctcccggataatttctggtagcaaagcctaccagtaagtcaataagacaaaggcgctaaatagcaacaaaaaaacgggtttattggcggatagaaaaaaacgaaagcacaaataatgggagcgtcaatttttcgagtttgctgacccgggagtgagtcttgttccactttgccaataacgccgtccataatcagccacgaggtgcgcgatgaatgcgactgcagcccagacaaaatctcttgagtggcttaatcgcctgcgtgcgaatccgaaaattccattgattgttgccggttccgcggcagtggcggtcatggtcgcactgatcctgtgggcgaaagcccccgactaccgcacattattcagcaatctttccgatcaggatggtggcgcaattgtcagccaactgacgcaaatgaatattccttaccgcttcagcgaagccagcggcgctattgaagttccggcagataaagttcacgaactgcgtctgcgcctggcacaacaaggtttgccaaaaggcggcgcggtcggtttcgaactgcttgatcaggaaaagtttggtatcagccagttcagcgaacaggtgaattatcagcgggcgctggaaggcgagctttctcgtaccatcgaaactatcggcccggtaaaaggggcgcgcgtacatctggcaatgccgaaaccgtctttattcgtccgtgaacaaaaatccccttctgcatcggtgacggtaaatctgttacccggccgcgcactcgatgaagggcaaattagcgccattgtgcatctggtttccagcgccgttgctggtctgccgccgggaaacgtcacgctggtggatcagggcggacatctgttaacccagtccaataccagcgggcgcgatcttaatgacgctcagttgaaatatgccagcgatgtcgaaggccgtattcagcggcgtattgaagcgatcctgtcgcctattgttggtaacggtaatattcacgcccaggttacggcgcagctggacttcgccagtaaagaacaaacggaagaacagtatcgccctaacggtgatgaatctcatgcggcgcttcgttcacgccagcttaatgagagcgagcaaagcggttccggttatccgggcggcgtaccgggggcgttgtcgaatcaaccggcacctgcgaataacgcgccaatcagcacgcctccggcaaatcaaaataaccgccagcagcaggcgagcaccaccagcaatagtgggccgcgtagcacacagcggaatgaaaccagtaactacgaagtcgatcgcaccattcgtcataccaaaatgaacgtgggcgatgtgcaacgtctgtcagtcgcggtcgtggtgaattacaaaaccttgccagatggcaaaccgttgcctctcagcaacgaacagatgaagcaaattgaagatctgacccgcgaggcgatgggcttttctgaaaaacgcggtgactcgctcaatgtcgttaactcgccgttcaatagcagtgacgaaagcggcggagaactgccattctggcaacagcaagcgtttatcgatcagttacttgctgccggtcgctggttgctggtactgctggtggcgtggctgctgtggcggaaagcggtacgtccgcagctaacacgtcgcgctgaggcgatgaaagctgtacagcaacaggcgcaggcccgcgaggaagtggaagatgcggtggaagtccgcctgagcaaagacgaacaactacaacaacggcgcgctaaccaacgtctgggggcagaagtcatgagccagcgtatccgtgaaatgtctgataacgatccgcgcgtggtggcgctggtcattcgccagtggataaataacgatcatgagtaacctgacaggcaccgataaaagcgtcatcctgctgatgaccattggcgaagaccgggcggcagaggtgttcaagcacctctcccagcgtgaagtacaaaccctgagcgctgcaatggcgaacgtcacgcagatctccaacaagcagctaaccgatgtgctggcggagtttgagcaagaagctgaacagtttgccgcactgaatatcaacgccaacgattatctgcgctcggtattggtcaaagctctgggtgaagaacgtgccgccagcctgctggaagatattctcgaaactcgcgataccgccagcggtattgaaacgctcaactttatggagccacagagcgccgccgatctgattcgcgatgagcatccgcaaattatcgccaccattctggtgcatctgaagcgcgcccaagccgccgatattctggcgttgttcgatgaacgtctgcgccacgacgtgatgttgcgtatcgccacctttggcggcgtgcagccagccgcgctggcggagctgaccgaagtactgaatggcttgctcgacggtcagaatctcaagcgcagcaaaatgggcggcgtgagaacggcagccgaaattatcaacctgatgaaaactcagcaggaagaagccgttattaccgccgtgcgtgaattcgacggcgagctggcgcagaaaatcatcgacgagatgttcctgttcgagaatctggtggatgtcgacgatcgcagcattcagcgtctgttgcaggaagtggattccgaatcgctgttgatcgcgctgaaaggagccgagcagccactgcgcgagaaattcttgcgcaatatgtcgcagcgtgccgccgatattctgcgcgacgatctcgccaaccgtggtccggtgcgtctgtcgcaggtggaaaacgaacagaaagcgattctgctgattgtgcgccgccttgccgaaactggcgagatggtaattggcagcggcgaggatacctatgtctgataatctgccgtggaaaacctggacgccggacgatctcgcgccaccacaggcagagtttgtgcccatagtcgagccggaagaaaccatcattgaagaggctgaacccagccttgagcagcaactggcgcaactgcaaatgcaggcccatgagcaaggttatcaggcgggtattgccgaaggtcgccagcaaggtcataagcagggctatcaggaaggactggcccaggggctggagcaaggtctggcagaggcgaagtctcaacaagcgccaattcatgcccggatgcagcaactggtcagcgaatttcaaactacccttgatgcacttgatagtgtgatagcgtcgcgcctgatgcagatggcgctggaggcggcacgtcaggtcatcggtcagacgccaacggtggataactcggcactgatcaaacagatccaacagttgttgcagcaagaaccgttattcagcggtaaaccacagctgcgcgtgcacccggatgatctgcaacgtgtggatgatatgctcggcgctaccttaagtttgcatggctggcgcttgcggggcgatcccaccctccatcctggcggctgtaaagtctccgccgatgaaggcgatctcgacgccagtgtcgccactcgctggcaagaactctgccgtctggcagcaccaggagtggtgtaatgaccacgcgcctgactcgctggctaaccacgctggataactttgaagccaaaatggcgcagttgcctgcggtacgtcgctacgggcgattaacccgcgctaccgggctggtgctggaagccaccggattacaattgccgctcggcgcaacctgtgtcattgagcgccagaacggcagcgaaacgcacgaagtagaaagcgaagtcgttggctttaacggtcaacggctgtttttaatgccgctggaggaagtcgaaggtgtcctgcccggcgcgcgtgtttatgccaaaaacatttcggcagaagggctgcaaagcggcaagcagttgccgctcggtccggcgttattaggtcgcgttctggacggcagcggtaaaccgctcgatggcctgccctcccccgatacgacggaaaccggtgcgctgattaccccgccatttaacccgttgcaacgtacaccgattgaacatgtgctggacaccggcgtgcgcccaatcaatgccctgcttaccgttgggcgtgggcagcgtatggggctgtttgccgggtccggcgttggtaaaagtgtgctgctggggatgatggcacgttacacccgcgccgatgtcattgtcgtgggtttgattggtgaacgtgggcgcgaagtaaaagattttattgagaacatcctcggtgccgaagggcgtgcacgctcagtggtgattgccgctccggcggatgtttctccgctcctgcgaatgcagggtgccgcctatgccacgcgcattgccgaagattttcgcgatcgtggtcagcatgtgttgctgattatggactccctcacccgctacgcgatggcccagcgtgaaattgcgctggcgattggcgaaccccccgccaccaaaggttatccaccgtcggtgtttgccaaattaccggcactggtcgagcgtgccggaaatggcattagcggcggcggctcgattaccgcgttttataccgtgctcactgaaggcgatgaccagcaggatccgattgccgactccgcgcgggcgatcctcgacggtcacattgtgctgtctcgccgactggcggaagccgggcactatccggctatcgatattgaagcgtcgatcagccgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgataaagccatcgccctgtggccgcagctggagggctatttgcaacaaggcatttttgaacgcgcggactgggaagcgtctctccaggggctggagcgtattttcccgacagtgtcataacccaggagataacggcagatggcagaacatggtgcgctggcgaccctgaaagatctggcagaaaaagaggtagaggatgccgcgcgcctgctgggtgaaatgcgtcgcggatgtcagcaggcggaagaacagctcaaaatgctgattgattatcagaatgaatatcgcaataacctcaacagcgatatgagtgccgggataaccagcaaccgctggatcaactatcagcagtttatccagacgctggaaaaagccattactcagcatcgccagcaacttaatcagtggacgcagaaagttgacattgccctgaacagttggcgagaaaaaaaacaacgtttgcaggcctggcagacactgcaggaacggcaatccacggcggcactgcttgcagaaaaccgcctcgatcagaaaaagatggatgagttcgcccagcgcgccgccatgaggaaacctgaatgattcgcttagcgcccttgattaccgccgacgttgacaccaccacattgcctggcggcaaagccagcgatgctgcacaagattttctcgcgttgttgagcgaagcattagcaggcgagacaactaccgacaaagcggccccccagttgctggtggcaacagataagcccacgacaaaaggcgagccgctgatcagcgatattgtttccgacgcgcaacaagctaatttactgatccctgtggatgaaacaccgcctgtcatcaacgacgaacaatccacatcaacaccgttaaccaccgctcagacgatggcgttggctgcggtggctgacaaaaatacgacaaaagacgaaaaagcggatgatctgaatgaagacgtcaccgcaagcctgagcgccctttttgcgatgttgccgggttttgacaatacgcccaaagtgactgatgcgccgtcaaccgtgttaccgacagagaaaccaacgctcttcacaaaactgacttctgagcaactcacaacagcacagcctgatgacgcccccggcacaccagctcagccattaacaccgctggtagcagaagcccagagtaaagcggaagtcatcagcacaccttcaccggtgaccgctgccgccagcccgctaatcactccacaccagacacagccactgcccaccgtcgccgcacctgttttgagtgcaccgctgggttctcacgaatggcaacaatcattaagccagcatatttcgctgttcacccgccaggggcaacaaagtgcagagttgcgtctgcacccgcaggatttaggtgaagtgcaaatctccctcaaagtggatgataaccaggcgcaaatccagatggtttcaccgcatcagcatgtacgcgccgccctggaagcagcgctgccggtactgcgcacgcagctggccgaaagtggcattcagttagggcaaagcaacatcagtggcgaaagctttagtggtcagcagcaggccgcttcccagcaacagcaaagccaacgcacagcaaaccatgaacctctggcgggggaagacgacgatacgcttccggttcccgtctctttacaagggcgtgtaacaggcaacagcggcgttgatattttcgcctaacgtcagaggtagcaccgtaatccgcgtcttttccccgctttgttgcgctcaagacgcaggataattagccgataagcagtagcgacacaggaagaccgcaacacatgactgattacgcgataagcaagaaaagcaagcgatcgctttggatcccgattctggtattcattaccctcgcggcctgtgccagcgcaggttacagctactggcattcgcatcaggttgccgctgacgacaaagcgcagcaacgcgtcgtgccctcaccggtcttctacgcgctggataccttcacggtcaatttgggcgatgcggatcgcgtactttatatcggcataaccctgcgcctgaaagatgaagctacccgctcgcggctgagtgagtatttgccggaagtccgtagtcgcttgctgttactgttttcgcgtcaggatgctgccgtactggcgacagaagaaggcaagaaaaacctgattgccgagattaaaaccacactttccaccccgcttgttgccgggcaaccgaaacaggatgtcaccgacgtgctgtataccgcttttattctgcgataacgacatgggcgatagtattctttctcaagctgaaattgatgcgctgttgaatggtgacagcgaagtcaaagacgaaccgacagccagtgttagcggcgaaagtgacattcgtccgtacgatccgaatacccaacgacgggttgtgcgcgaacgtttgcaggcgctggaaatcattaatgagcgctttgcccgccattttcgtatggggctgttcaacctgctgcgtcgtagcccggatataaccgtcggggccatccgcattcagccgtaccatgaatttgcccgcaacctgccggtgccgaccaacctgaaccttatccatctgaaaccgctgcgcggcactgggctggtggtgttctcaccgagtctggtgtttatcgccgtggataacctgtttggcggcgatggacgcttcccgaccaaagtggaaggtcgcgagtttacccataccgaacagcgcgtcatcaaccgcatgttgaaactggcgcttgaaggctatagcgacgcctggaaggcgattaatccgctggaagttgagtacgtgcgttcggaaatgcaggtgaaatttaccaatatcaccacctcgccgaacgacattgtggttaacacgccgttccatgtggagattggcaacctgaccggcgaatttaatatctgcctgccattcagcatgatcgagccgctacgggaattgttggttaacccgccgctggaaaactcgcgtaatgaagatcagaactggcgcgataacctggtgcgccaggtgcagcattcacagctggagctggtcgccaactttgccgatatctcgctacgcctgtcgcagattttaaaactgaaccccggcgacgtcctgccgatagaaaaacccgatcgcatcatcgcccatgttgacggcgtcccggtgctgaccagtcagtatggcaccctcaacggtcagtatgcgttacggatagaacatttgattaacccgattttaaattctctgaacgaggaacagcccaaatgagtgacatgaataatccggccgatgacaacaacggcgcaatggacgatctgtgggctgaagcgttgagcgaacaaaaatcaaccagcagcaaaagcgctgccgagacggtgttccagcaatttggcggtggtgatgtcagcggaacgttgcaggatatcgacctgattatggatattccggtcaagctgaccgtcgagctgggccgtacgcggatgaccatcaaagagctgttgcgtctgacgcaagggtccgtcgtggcgctggacggtctggcgggcgaaccactggatattctgatcaacggttatttaatcgcccagggcgaagtggtggtcgttgccgataaatatggcgtgcggatcaccgatatcattactccgtctgagcgaatgcgccgcctgagccgttagtgatgaataaccacgctactgtgcaatcttccgcgccggtttctgctgcgccactgctgcaggtgagcggcgcactcatcgccattattgccctgatcctcgctgctgcctggctggtaaaacggttgggatttgcccctaaacgcactggcgttaacggtctgaaaattagcgccagtgcttcactgggcgcgcgtgaaagggttgtggtggtcgatgtggaagatgcacggctggtgctcggcgttaccgcaggtcaaatcaatctgctgcataaacttcccccttctgcaccaacggaagagataccgcagaccgattttcagtcggtcatgaaaaatttgcttaagcgtagcgggagatcctgatgcgtcgtttattgtctgtcgcacctgtccttctctggctgattacgcccctcgccttcgcgcaactgccgggtatcaccagccagccgctgcctggcggtggacaaagctggtcgctcccggtgcagacgctggtgttcatcacctcgttgacgtttattccggcaattttactgatgatgaccagtttcacccgcatcatcattgtttttggtttattgcgtaacgcgctgggaacaccctccgcgccacctaaccaggtattgctggggctggcactgtttttgaccttttttattatgtcaccggtgatcgacaaaatttatgtagatgcgtaccagccattcagcgaagagaaaatatcaatgcaggaggcgctggaaaaaggggcgcagccgctgcgtgagtttatgctgcgtcagacccgtgaggcagatttagggttgtttgccagactggcgaataccggcccgttgcagggacctgaagccgtgccgatgcgcattttgctcccggcctacgtgaccagcgagttgaaaaccgcatttcagataggcttcacgattttcatcccttttttgattatcgacctggtgatagccagcgtgttgatggcattggggatgatgatggttcccccagccaccattgctctgccctttaaactgatgctgtttgtactggtggatggctggcaattgctggtcggttcgctggcgcagagcttttacagctagagaggcaaaatgacacctgaatcggtcatgatgatggggactgaagcgatgaaagtcgcgctggcactggctgccccgctattgttggtagcgttggtcacgggccttatcatcagtattttgcaggccgccacgcagattaacgaaatgacgctgtcgtttattccgaaaatcatcgccgtatttatcgccattattattgccggaccgtggatgctcaatctgttgctggattacgtccgcaccttgttcactaacctgccgtatatcatcgggtagccgtactatgttgcaggtgacaagcgaacaatggctatcctggttaaacctgtacttctggccgttactgcgcgtgctggcgctgatctccaccgcgccgattctgagcgaacgcagcgtaccgaaacgggtaaaactgggtctggcaatgatgatcacgttcgccattgccccatcattacctgccaacgatgttcctgttttttcgttctttgctctgtggctggccgtgcagcagatcctgatcggcattgcgcttggttttaccatgcaatttgcctttgccgctgtgcgaaccgctggcgaaattatcggtctgcaaatggggctgtcatttgcgacgtttgtcgatccggccagccatcttaatatgcccgttttagcgcgtatcatggatatgctggcgttactgctgttcctgacatttaacggtcatttatggttgatttcactgctggtcgatacctttcacaccctgccgattggtggcgaaccgttgaacagcaatgcgtttctggcactcaccaaagcagggagtttgattttccttaacgggctgatgctggcgttaccgctcattactctgctgctgacactgaatctggcattaggtttacttaatcgtatggccccgcaattatccatttttgttattggatttccattaactctgactgtcggcatctctttaatggcggcattaatgccgttaattgcacctttttgcgaacatttattcagtgaaatttttaatttgctggctgatattattagtgaattgccattaatataattccgtaacgtttatcatgttatcctaaggattatccgaaaaataatacctacgaacatcttccaggatactcctgcagcgaaatatttgttttaagctcactcacatatcgcaacatttactttactttaagacaattccaggcaaattatacaacactttacgggatagtaagtccgcctgaaaaatcgcgagagtggcgcattaggtgacccatgttgttccgtttagtcatgatgaaatattcaggtaaggggaattatcgttacgcattgagtgagggtatgccatgtcaacgattattatggatttatgtagttacacccgactaggtttaaccgggtatctgttgagtagaggggttaaaaaaagagaaatcaacgacattgaaaccgttgatgaccttgccatagcttgtgattcacagcgcccttcagtggtgtttattaatgaggactgtttcatccacgatgcttctaacagtcagcgtatcaagctcatcattaatcaacatcccaatacgttatttatcgtttttatggcaattgccaatgttcattttgatgaatatctattggtcagaaaaaatttattgatcagttctaaatcgattaaaccggaatctctcgacgatatccttggcgatattctgaaaaaagagacaacgataacctcgtttttaaatatgccgacgttatcattgagccgaaccgaatcgagtatgttgcgaatgtggatggcaggtcagggaaccattcaaatctctgaccaaatgaatatcaaagccaagaccgtttcatcgcataaaggtaatattaaacgtaagatcaaaacgcataataaacaggttatctaccatgtcgtccgactgacggataatgtgactaatggtatttttgtcaacatgcgctaacacattctgactggtggtttcccaccagtcaggctgaataagattactctgctttctccacaaagataccgtcctgatgccctgcttcattaaagaaccagatgccgagcgggtagtcttccagcgaaaccaggtacattgtgccttcactaaactcctcaactgccagtaccacgccaggacgacgcggaccgccatccgttttgactgttacccgatcattcaccttcatcgttttcctcctgtggctttgtgccagtgtagaacaatttcgtttttctggcagcgccaggcgcgcgcgagtgctgattttctcgacggtctatacttaagagatgccaggcggacttaacgactggcggcaacaacagagtaacggttgcgaggaaagatgatgaaaaccgcaaaagagtacagcgataccgcaaaacgtgaggtcagcgtcgatgtcgatgccctgctggcggcgatcaatgaaattagcgaaagcgaagttcatcgcagccagaacgattctgaacacgttagcgtcgatggacgtgaatatcatacatggcgtgaattggcggatgccttcgaactggatattcatgacttcagcgtctctgaagtgaatcgttgaatgcacaataaaaaaatcccgaccctgagggggtcgggatgaaacttgcttaagcaagaagcacttaaaaaattcgttacaccaggaaatctgatgtgttcatcaccttatccgcaatttttttcgctgacaagaaaatattcgccatatgaatgattaacgctacttatgaatagaaatgtgacgcacgtcaccccttggtggctctggcgtcagcgggatcgctcccgaaaaaatcatctttgataatttgtgcggttttgagaatcatcctggtaagaggagtactgcgcgactatgttttcaattcaacaaccactactggtttttagcgatcttgatggcaccctgctggacagtcatagttatgactggcaaccggcagccccctggctcacccgtttacgcgaagcaaatgttcccgtcattctctgtagcagtaaaacatcagcggaaatgctgtacttgcaaaaaacgttggggctacaaggtttaccgctgattgccgaaaatggcgcagtgatccagcttgctgagcaatggcaggagatagacggttttccacgcatcatctcaggtattagccatggcgaaatcagcctggttttaaatacgctacgcgagaaagaacattttaaattcacgacttttgatgatgtcgacgatgcaaccatcgccgaatggacgggattaagccgtagccaggcggcgctgacgcagcttcatgaggcgtcggtaacgctaatctggcgcgacagtgacgagcgtatggcacaatttaccgctcgtctgaacgaactgggcttacagtttatgcagggtgcgcgcttctggcacgtactggatgcttctgccggaaaagatcaggctgccaactggattatcgcgacctatcaacaattgtcaggcaaacgcccaaccacacttggcctgggcgatgggccaaacgatgcgcccttactggaggtaatggattacgcggtgattgtgaaagggctaaatcgtgaaggggtgcatctgcatgatgaggatccggcccgcgtctggcgaacgcagcgtgaaggaccggaaggatggcgtgaagggctggaccattttttctccgcccgttaagcgttatcgctcgcgaatacccgattacgcccagcctgtttagcgagataaagccgacggtcggccagtgactggagttgttcaaaatcataatcaccggtttcctcgctgctgcttacccccagcgaggcactgatgcgtatcgtcgtactcttggcgatcaacatctctttttcatttaatttcagtcgaatacgttctgcgacctccgcagcctccgtcagactcgcgcctggcagaatcacacaaaactcctcaccaccgacccgcccggcaacgtcctgcgcacgcaaggaactgctaattaatccggcagcatgagaaagaacacggtcgcccgcctgatgaccaaagcggtcattaatcgctttaaaatggtcaagatcgacctgaatgacagaaaaaggatgttggtgcgtctgacacaatttagcgagcggacgggctttttcgaacagtgcgccacggttatataaacgcgttaaggtgtcgtgccacgcctgccactgcaacgagctttgcagaacatacatgttgctaaccatccggcgaatcacataccaggagatgagtaacatggtggtaaagagcgcccacagcagggttaatgcaatgctgatactgccgaaatcgccgcgcacgccttcgcttaacgtatggacacgcaccagcacaccgtcgaaatggtccagacgttcccagctaacatagcgactgtccatacgaatgccgccccgcgtgtcatgttccattgcctgcgccagcaaggccagttcacgaggatcaaaaatattccctgttggatggtcaggattggaagaggtcaaaaatctcagcttactgtcatagagctgatactcaccatcgaggtttttatcgatggcgtttcttaaaaattgctgcatagtacgcacgggaatactcatccccagcacgccataccagtagttattactgtctaccggaacactgacggtaacctgcggttcagtattgctggcgtgttccggttgcgaagtgaaccagcgtaccgcgcggtgacgattttctcgttgtgaatggccaataaaccagggttgggtgacatagccgtaataacgcgttggaacattgcgcgtaaacaaggtcggctgcgtcgaaacgtaaaatccggcacgcgagacatacatcgcctgttcaaccatcgacgaggagttgtgcgctagtcgcagcaagtaaccaacttccagtgcagcggtaatttcattgtcgaggctttcattttcgcgagacaggagattcccctcgctgactaatgcatccgacacaccattaactggcagagtgcgtcgtcggttgagttcgattttccaggcgtgctcgtcgcgatgctgttcgaactcggttacagcatcacgcagagaggtgaaatccagtggcgctacgagagcttcgcgcatgccattacgtaaaaagatcagtttgtcgacgttatactgcaaatgcttatcgagcgcgttggcaacgttttccagatgattacgctggctggagatataggcatcttccagcaccaccacttcacgccaggtgagcaaggtggaaaaaagcaataccacgataaagcagagattaacgacatgaccaggccccaggcggcgtgcgagttttttcaaccagctctggttttccatttttgtctcgtgctgcaccctgacgactcccaacctgcttttttatgattctggcataacctggcgatagcgtaccgcaaaacagcgataattttataatggtggcatgataagacgcgactatcattcattgcaggcattagcacaccaggccggatgtgatccggcctgatgttaatgataccctttcacacttcttccgcagaacgactcccctcccccggaacaagctcggtttcatgaaaagcttcccgcttgaccccgtaaccgtcataccaacgacactcaaccataccgctggagtatccagtgacaatcatccgcgggccgccctctttaaccgtaacttcctcactaaccataaagctcatactcgcctccttttttcgagtgaaacttgttcaccttagttgaagatggcgaattttgcataatagccagtgcgagtattaatgtgcctgaccgcgcattttctctacggctttcactcccagcaccacgatgccgccgatgataaatccaagaatcagatttaaaacagtcggtaatatcatcgccactactgcactttgctgcccggcgaaatgttcaatggcgtgatgcagcggcgcaattccatgtaccacaatcccaccgccgacgaggaacatcgccagcgtgccgacaatcgataacgctttcatcagccagggcgcgataatcaataaccctttacctaatgcctgcatcagcgcgctggatttttccgccagccaataccccaggtcatcaatcttaacgataacccctaccagaccgtagacgcccacggtcactaccagcgcgatgcctgaaagcaccagcacctgattaagcaacggcgcttcggccacaatccccagcgtgatggcgacgatttccgcagacaatataaaatcggtacgaatcgccccttttattttgtccttttcaaacttcagcggatcctgcgccgccagcttctccagacgctgctggctctgcgccggatcttctttatgtttacgcgcctccagcatatgcagcactttctctactccttcaaagcagagaaacgcgccaccaatcatcaacagaggcgtaatcgcccacgggataaacgcactgatgatcagcgccagcggcaccagaatcactttattaatcagcgatcctttcgccacgccccagaccacgggaagttcccggttggcccgcacgcctgaaacttgttgcgcattgagcgataagtcatcccctaatacaccggcggttttcttcgccgccagtttgcccatcacggagatatcgtccagtagtgtggcgatatcatcgagcaacgtcagtaaactactcccggccaaaagcattccctctcatttttattgttgaagggtgtaagtatgaagcaaaaacggcagctctgatacttgcttcacaggtcaacatttttttaacaatcaagtgcaattatatctctcgccagcagaatgattttcacgtttactatgaaccacctttttatttccaccgtgagggattatgcgtttccgccagttgttaccgctttttggcgcgctgtttgcgttgtatatcatttggggctcaacctattttgtcattcggattggcgtggaaagctggcctccgttaatgatggcgggcgttcgattcctggcagccggtattttattgctggcatttttgctactgcgcggacacaaactccccccgctacgtccgctgctcaatgccgcgctgattggcctgttattgctggctgtcggtaatggcatggtgacggttgccgaacatcaaaatgttccttccggcatcgccgccgtagtggttgcaaccgtgcccctctttaccctgtgcttcagccgcctgtttggcattaaaacgcgcaaactggaatgggtgggtattgccattgggcttgccggaatcatcatgctcaatagcggtggaaatttaagcggcaatccgtggggcgcgattctgattttaatcggctcgattagctgggcgtttggctcagtttatggctcgcgcattaccttacctgtagggatgatggcgggtgcgattgagatgctggcggcaggcgtggtgttaatgatcgcgtcgatgattgcgggtgaaaaactgacggcgctcccttccctttcaggcttccttgcggtcggctatctggcgctgtttggttcgattatcgccatcaacgcttatatgtatttaatccgtaatgtcagtccggctctcgccaccagctacgcttacgttaacccggtggtcgcggtcttgctgggtacgggactgggtggagaaacactgtcgaagattgaatggctggcgctcggcgtaattgtcttcgcggtggtactggtcacgttgggaaaatatctcttcccggcaaaacccgtagttgcgccagttattcaggacgcatcaagcgagtaaatgaatcccctgcgtgtcgatctgcgcgctggcaccttcgccgcagatccactcttccagacgctcggtaagcgcttcatccgtcagcttctcgcgcccacgtaacgcgcactcccagacaatcaatacgcgccagccgagttcctgcaagcgactgatatcgcggcgatcgcgctcaacatttttacctatcttctccagccagaactcggttcgagtcgcaggcactttaaacagatagcagtgatgatgatgccagaagcagccatgggtaaatatcacgcagcgatattcatcaacgacaaaatccggacgtccgggcagactggcgtcctgaacgcgaaatgccaggccctgcccggttaacagactggcgaggcgcttctctatcgccgtatcacgcgtggcaatcgcgcgcatatttttgctgcgagtggccttatcgtgaacgtcggccatgttgtgcctcttgctgacgcaacgccaccgcctgtttgatttttggctcaagcagttttgccaccgcggcaaagaccggcacgaccaccgagttaccgaactggcgataggcctgagtgtccgaaaccggaatacggaatttcgcttctcccggcgcttcaaaacccattaagcgcgcgcattcccgaggcgttaaccgacgtggacgatgttgctgattcagcggatcgtcaaagtctttctcacccgtggccatatcccagccgcgatcgattaaaatttccgcgccatctttgtaataacgcgcagacagcgtacgcgtgacgctttgcggattgttcggataaaccattccataaccgaagccgttaccgcgcgcctgatgttttttcgcatatcgatagaggtacttccacagcaccggcgtcaggatatatttcgcctcgaccatcgggtccaacagctgcgccagcgtcactcgctgcgcagggaaacattcgctgatatcacgcagggtaaaatcggctttcagattcagatcgcgacgaaaacccaccagcacgatgcgttcacggtgctgcggcagaaaatgtttgccgtcgatgattttcggatcgtctggcccattatcttctgcatcagccacgtcatagcccagttcgtccagcgtctgcatgatgatgcggaacgttttaccctggtcgtgacttttcaggtttttgacgttttcgagcacaaacatcgccggacgacgcgcgtcgataatgcgtaccacatcaaaaaacagcgtgccctgggtatcgcaggcaaaaccgtgcgcccgcccgagcgagttctttttcgatacgccagccagcgaaaatggctgacaagggaaaccggccagtaaaacatcgtgttcaggaatgtgttgacgaatatgttccgccgccgcctcatcactcacgccttctttatggctgagggtgatgtcgcggatatcttcattaaaatgatgcgtcgccggatcgcaataatggttggctttataagtgcgtaccgcatgtttgttccattcgctggtaaacacgcactgtccgccaatcgattcaaaaccgcgacggatgccgccaattccggcgaatagatcgataaagcgaaacgcataatgcggatgatgtgccggtggtttgggtaataacgtttgcagatgggcgaactctttctcacttaaacggtgccatgccgagtcattcgccagcgcacgttttaaaattgccgcgctccagtgattctcacctacaccattaagctgcgccaccaacgttttaacatcataaatttgcagcagtttctccagcattgcctgtgcggcattcccggtgctgtatgaatcggttactgatatattttcctgcatagatttcaccggccatctgagatggccgacaggttaacataattacagccatttagggccacgcgctcagccagcggatgaaaacgcatctatcaccttgtgatcgacaccttcattctcccccgccagttcggcactgagcttcgccataaactcgactaaaaaatgcgcgttgtgctgcgccagctgcttgcctcttgcggtttgcatggtttgcggtagcttcagcaacttagtctggaaatgatccagcgcgtagcgtttatcatcaagcgggcgatgctgtgcgaacggatcttcaccatcaaacagcgccacgcccaatgcccctgaaacggcaaacacgcgcgccaggccaatcgcccccagggcttccagccgatccgcatcctggacaattttagcttccgttgttaagggggcgatttgcgcgctgaaactgtgagcggcaatggcatgacaaacggcctcgattttctccgccggaaattgctcgaactcttcacggagcaggcgacgcgtctcttctgccgccaggattgaagaacgctgcctttgcggatgatttttcgccaggctcacaatatcgtgaaaataacaggcggttaaaatcaccagcatatcgacatcgtcatctgccgccagcttctgtgccgtagcccagacgcggcgaaaatgacacacgtcatgggccgcgtcctggtgctgatgatggtttttcaaccagttttcgaactgtgcctgccagtgttgtaagtccatacgcgctccgttgccaaagagtcgccaccttagcagtttttattcatagcgtctgctacgtgcgggacgaggtcgggtgtaccaggcaatgctgcctaacaatgccccgaccagagccataaataaaaatccgaccagtgcccctaaccactttcccgcggtagagcctaaatcgctttcaaatcccgacacgggggcatcgggaatccggctcatcacccagatgtaacgcgccattgcccagacgaaatagccacaccatgtatagaaagcccacaaagccagtttgccgccagggctgcgagagagtctctcttccatctttgtcgaaccgtattccattttgagataacccggaaaattcagacttagtactattatgtgataaaagtcacatttttccacattggatgagccagtcaagactcaatcattttttgaacaaatagataaattttgcgcaacggcagtgaatacaggaaaaatcgttttgagcgattttatttatctttgatatcggctttattaattcatttaatcaatatattagcactgattacaattatacctttttattattctgtgtcatgatgcttccgttattagccttttatcgtcttgtttatattttttgggccggcatgatgccggcttttttttatgccttcattaatgtgcgcctgatcacaccagccgtttggcgcaacaatcattgataccccctatgtttccgctcaactcataacatattgatatacatttataattttcatgaatatttatatttagaattcataattatgaattatattaaatagattagaaacattttgatatcttttaaatacatttgttacatgtaatccttaaaataaaatgaacttcatagaatagtatccaaatgtgcttttttttggataacggcacttattgatatattcatgaagattataatcacaagggaatacataatgaaaagaaaagttctggcaatgctggtcccggcgttattagttgctggcgcagcaaatgcggctgaagtctataataaagatggtaataaactggatttgtacggaaaagtagtgggtctgcactacttctctgatgattctggcagcgatggcgacatgtcatatgcccgtatcggtttcaaaggtgaaactcagatcgctgatcaattcactggttatggtcagtgggaatttaacattggcgcaaacggtcctgaaagcgacaagggtaataccgcaacgcgtctggcatttgcaggtttaggctttggtcagaatggtactttcgactatggtcgtaactacggtgtcgtatatgacgtagaagcatggaccgatatgctgccagaatttggtggcgatacctatgctggcgctgacaacttcatgaacggtcgtgctaatggtgttgcaacctaccgtaacaatggcttctttggttaggtcgatggcttgaactttgctttgcaatatcagggtaataatgaaagtggtggaccattcgggcaggaaggttccggtagtggtgatggccgtagcctttccaaagaaaatggtgatggtttcggtatgtcaacatcctacgacttcgacttcggtttaagtctgggtgctgcatatcaaactctgatcgttcagatcgtcaggttggagttggtttaaatgatcgtaaccatagcaacagaaatgctggtggtgaaaccgctgaagcatggactgttggtgcaaaatatgatgctaataatgtgtatttagcagctatgtacgctgaaactcgcaatatgaccccatatggtggtggcgagtttgataatggtgaatcaagatcagccatcgctaacaaaacccaaaactttgaagttgttgctcagtatcagttcgactttggcctgcgcccgtccatcgcttacctgcaatctaaaggtaaggatttaggcggttgggctcatgacggcaacggcgacccacgttacaccaataaagatctggttaaatacgttgatattggtgcgacctactacttcaacaaaaacatgtccacctatgttgattacaaaatcaacctgctggacaacgacgatgacttctacgaagcaaacggcatcgctaccgatgatatcgttgctgtgggcttagtctaccagttctaatcagtcaactcgctgcggcgtgttactgtaaaactgaacactagcctgagttcgtccctcatcgaactcaggcttttttattggcatttcatctccatctgcggcacacgcaattgccgaagcatatcgatacagcaccttaccctgcccctcctggcacaataacatcaaccagctactcttcaagctaacacccaaatgcatttctttatgaattaatccgtaacaaacacgcttcccatatagaaatatttgcaaaaatagtgcatgaaataagctttttctctaccaatccgggatataaatattcatcagcaccacaatattccacagcactaaatctctccccgccaccccgtacctctgataatggtctaaaatcattgaagccacttgcgacgacgttgctcaataaggaaaatttggcgtgaataatattcaacaccagtgcagcatcatcattacatacttacagccgccgactaccgctttcgatatattgactcaattttccagcctggttaaaaatagcgaccagctcagtcgcaaatatagtgactaccctaactaagcaacaataaggaatacactatgactgttcaaacaagtaaaaatccgcaggtcgatattgctgaagataatgcattcttcccttcagaatattcgcttagccaatataccagtcctgtctctgatcttgatggcgtggactatccaaaaccttatcgcggtaaacataaaattctggtgatcgccgcggacgaacgttatttgccgaccgataacggaaaactgttctcgaccggtaaccatccgattgaaacgttgctgccgttgtatcatctccatgctgcaggtttcgaattcgaagtggcgaccatttccggtctgatgaccaagtttgaatactgggctatgccgcacaaagatgaaaaagtaatgccattctttgagcagcataaatcgttgttccgcaatccgaagaaactcgcggatgttgttgccagcctcaacgctgatagcgaatatgcagcaatctttgttcctggtggtcatggcgcacttattggtttacctgaaagccaggacgtggctgccgctttacagtgggcaatcaaaaatgaccgttttgttatctccctttgccacggcccggcggcttttctggcgcttcgccacggcgataacccactgaatggttattccatttgcgcattcccagacgccgcagacaaacaaacgccagagattggctatatgccgggtcatctcacctggtacttcggcgaagaactgaagaaaatgggcatgaatatcattaatgacgacatcaccgggcgagtacataaggaccgtaaacttctcaccggcgacagtccttttgcagcgaatgcgttgggtaaactggcggcgcaggaaatgctggcagcttacgcgggttaatccctgttacgtttgaatgtaagcgcataatcaatcgcggccgcgttagtactcacgacgtggctgcgttttttcacggttaatttatggcgtactgaagccctatgttaatttctttgcggtaacgtaatccggaacacattatgcttattgagatagtgatacgtagcacttcccccatgcaattcggcaatcgctttgactaaagaaaggcctagtccctgacctacggaatgacgcgaattatctccccgccaaaatctacggaagagtttttcaggctcattaattttcgttccagggctggcgatatcaatattaagatagctgttggtatcaagaaaactggttatatgaatacgcgatttttctggcgaatatctaatggcattaacaataagattcgataacattcgttgtagtaaaattttatccgcaaagatttgctgattgcactcgaccttaaagcaaatctctttctcgtctgaaaggtattcaagatagtccaacaaattttcgacttccttattgagagaaagcgagtccagtttcaccaaaacattgtttttatctgccctggcaagaaacagtatgttctctgttaaccgcgaaatattttccagctcttcaatgtttccggcaattgttttttgatattcagcgatacttctggtttgactgagcgtaacctgattctgacccagtaatgcattaattggcgttctaagttcatgagcgagatcgtcagcaaactgacttagacgctcaaaatctttgactaaagcatgatgcattttattcaacgcctgcccaagaggttttagttctctcggtaatgcgctaacctcaacaggctctcggctatcgttataattcagcgcttccgttacaccactcaactttttgatctctcgtaatcccgttctgattaacagcggacttaatactgagcaaagtacaatggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcactagcaggtatgttatttaacatgccatcactgacatttgtccggttaacaattttattgatgctatcaccatgaataatcaagatatcctgactaacatccatcatccggttaaagtacacaggtaacgtatctggatttaccccatcaattaacaactgcttgatctgcgctgtccggttaatgagtgttgtatcatcgcgccatttcaactcacttgccaggccattatagagagtccagacaattccggcgccagcaacagacagtagcaatataaaaagcaaggttaaacggacggttatagatagtcttttcattatttttttaccgctacgaatgaatagcccatcccccggattgtggcaattagcttttcaggaaaaggatcatcaacttttgcgcggagcctgcgaatggcgacgtccaccgtattggtatcactatcaaagttgattccccaaatttcactcgcaataaccgttctgggtataatttcgccagctctggaggccagtagccaaagtaactgaaactccttgcgcgtcagtgtaatactgatattgtccctgctcacactatgactaacagagtccattcttaagccgctgatttctaatgttgaattcaaagcgtgatgttgccttaattgtgcccgaacccttgccagcaactcagaaaatgaaaaaggttttaccagataatcatttgccccactgtccagccctctgactctgtcatcgacagaatcccttgcagtaaggcaaataacaggggtttgctttgctgttcttaacgtttgtaagatctgccagccatccatacccggaagcataatatccagaatgatcaatgcataatcatccttcagcgcaagataaagcccatctctgccatcagaaacggcatcgatgacataacccgcttcggaaagcccctgcgttacccattcctgggtcctttgattatcttcaataagtagaatcttcatgaaaataatatgccataaatcatatgttatagaaacagcctggttcattacaaaattgtaatgctgctgtaaggttaccctggacgctttttcgctatcctcaaaactcattcacatgacaaggatataaacatgttaaagcgttatttagtactctcggtagcaacggcagcattttcattaccttctttggttaatgccgcacaacaaaacattcttagcgtgcacattttgaaccagcaaacaggaaaacccgctgctgacgtgacagtcactcttgaaaagaaggcggataacggctggttacaacttaataccgccaaaacagataaggatggacgaattaaggcactgtggcccgagcaaactgcaactacgggcgattaccgtgtcgtatttaaaaccggggactatttcaagaaacaaaatcttgaaagtttcttccctgagatccccgttgaatttcatattaataaagtgaacgagcattatcatgtgcctttattacttagccaatatgggtattcaacctatcgtggcagttaatgcataaatatgtaaaagcagatctctgctactgttagggaggacactccctgacagattaacagtaaacggctcttgctggctaacgacaaaaaagtgtgatggcttatgaaaaagaatcaatttttaaaagaatcagatgttacggccgagtcggtattctttatgaagcgtcggcaggtgttaaaagcactgggcatcagtgcaactgcactttctttgcctcacgctgcgcatgccgatctgcttagctggtttaaagggaacgatcgcccgcccgcccccgccggaaaagcgctggagttcagcaagcctgccgcctggcaaaataacctgccactgacgccagcagataaagtttccggttataataacttctatgaattcgggctggataaagccgatcccgccgctaatgctggtagcctgaaaaccgatccatggacactgaaaatcagcggcgaagtggcaaaaccattgaccctcgatcatgatgacttaacccgtcgcttcccgctggaagagcgtatttatcgtatgcgctgcgtggaagcgtggtcgatggtggtgccgtggattggttttccgctgcacaaattgctggcgcttgccgaacctaccagcaatgcgaagtatgtcgctttcgaaacaatttatgcaccggaacagatgccaggccagcaggaccgctttatcggcggtgggctgaaatatccttatgtcgaaggattgcgtctcgacgaagcaatgcatccgctcacactgatgaccgtaggtgtttatggcaaggcgttaccgccacaaaatggcgcgccggtgcgactgattgtgccgtggaaatatggctttaaagggattaaatcgatagtcagtattaagctgacccgcgagcgtccgccaaccacctggaatctggcagcgcctgacgaatacggtttttacgccaacgttaatccgtatgttgatcacccgcgctggtcacaggctaccgaacgatttattggttcaggcggcatcctcgatgtacagcgccagccaacgctactgtttaatggttacgccgcccaggtggcatcgctgtatcgtggcctggatttgcgggagaatttctaaatgcgtctgacagcaaaacaggtgacatggctgaaagtttgcctgcatcttgccggattgttgccgtttctctggctggtctgggcgatcaatcacggtggactgggtgccgatccggtgaaagatattcagcattttactggtcgcactgcactgaaatttttgctggcgaccttgttaatcacccctctggcacgctacgcaaaacagccgttattgatacgcactcgccgcctgttaggattatggtgctttgcctgggcgacactgcatttaacaagttacgcattgctggagctgggcgtgaataatctggcgttattaggtaaggagttaattacccggccttatttaacgttaggtattatcagctgggtaattttgcttgctttagcgttcacttcaacccaggcgatgcagcgaaaactcggcaagcactggcaacagttgcataatttcgtctatcttgtcgcgattctggccccaatacattatctgtggtccgtgaagattatttcaccgcagccgctcatctacgctgggctggctgtactgcttttagccttacggtataagaagttgcgttccctttttaaccggttacgcaagcaggttcacaacaaattatctgtataacttcatattgccgacaaagtacgcgttatccctgccggatgtggcgcgagcgccctatccggcatacacagatcgcatcaggttatgtttcgtttgtcatcaacctcaaatcaccaaaataatttattttatttcaataagatagataagtagaactgagaaagccatgctctcgtttcctaagagttgttgcattttgctatatgttacaatataacattacacatcatatacattaactctggaggaaactgttttggcgattcgtctttacaaactggctgttgctttaggtgtctttattgttagcgctcctgccttttcgcatggtcatcactcacacggcaaacccttaacagaggtcgaacaaaaagctgctaatggtgtttttgatgatgccaatgtacaaaaccgaacgctcagtgactgggatggagtctggcaatccgtttatcctttactgcaaagtggcaaacttgaccccgtctttcagaagaaagcggatgcagataaaactaaaacatttgctgaaattaaagattattatcacaaaggttatgcaacagatatcgagatgattggcattgaggacggcattgttgaattccatagaaataatgaaacaacatcgtgtaaatatgattacgatggatacaaaatactcacctataaatcaggcaagaaaggcgttcgttacttattcgaatgtaaagatcctgaaagcaaagcccctaaatatatacaatttagcgatcatataattgcaccacgaaaatcatctcattttcacatttttatgggtaatgattcacagcaatctttattaaatgaaatggaaaactggccaacgtattatccatatcagttgagtagcgaagaagtggtcgaggaaatgatgtctcattgagtattctcatgataacgcctcgatgccgctttagtaagttatcataactgccactggtccatccacaaacgccactgaacgcaagctagctacagacacgctcatcactatgacgtgtctgtatattaataagctaacccgcattgagttaaccaataacggattccatacacaatacggccaacagagaaagatacctgtgctcacgccattgcttatattggctggttacaatatgcactatcaattttttaaataacaaattattaaaaccacatctgtataaggaatttttaaggttcgtgggatagcttgactgtgaaaatcacaggagctacaaaaatgaaccgattctcaaaaactcaaatttatttacattggataacgctgcttttcgttgcaataacctatgccgcgatggaactccgtggctggtttcctaaaggtagtagtacttatctgctgatgcgagaaacacattacaatgcgggtatattcgtttgggtgttaatgttttcacgcctgattataaaacaccgttatagtgatccttctattgtgccaccgccacctgcctggcaaatgaaagcggcttcgctaatgcacatcatgctttatataaccttccttgcacttcctctgctggggattgctttgatggcttacagtggaaaatcgtggagtttccttggtttcaatgtgtctccctttgttaccccaaacagcgaaattaaagcactgataaaaaatattcacgaaacctgggcaaatataggctactttttaatcgcagctcacgctggcgcagcactctttcatcactacattcagaaagataatactctgttacgaatgatgcctcgccgcaaataagtcgatccccttacaaggaaatgtgaaccatggacatcaacgcgtcataaatgtttacgcaagtgcacaatgcaccctttccactatcaacaaggaggagcagaaactgtgtaaatcgtacaatggtaagacttatcaaaaatacaggttaattttggtatttaaaccttttttacttgttagtatgatacaaaggctttcaaaaaagctgcgaaattcaacaactcttggaaattatggactttgtcccgcggctttaatctgacggccgcgttccttttttgactcaattattgaacccttctctacgcaacttcagttcccaccaccaactttgcggcagtttcataggatgaatgtctaaaagaataatggtgagcgataagaaaacgactgaataactgcacattttcgctcgaaagcttcctgtcagatccatagcgaatcaagtgctgaatgtcacagtatcgaacagaaaacagtgacgatctaacccttcaagaatattctacgattgttctgtttaggaaaagcaaggcgggaagtcgggagataagtcattgataaagtggcggagagagggggatttgaacccccggtagagttgcccctactccggttttcgagaccggtccgttcagccgctccggcatctctccgttcagatggttgccatgatgccaggaaatttggcattttaacagtccctgtccgtgcaattttgttcaagtgacgagtttgcgagcaaaacgatgattaagtggccctggaaagtacaagaatcagcacatcaaactgcccttccctggcaggaagcactatcgatcccccttttaacgtgtctgacggaacaggaacaaagcaaattagtcactcttgccgaacgttttttacagcaaaagcggcttgttcctttacagggctttgaactggattcattaagaagctgccggatagcacttctattttgcctacccgttctggagttaggactggaatggctggatggttttcatgaagtcttaatttatcctgcgccatttgtggtcgatgatgaatgggaagacgatatcggtctggtgcataaccaacgtattgttcagtcaggtcagagctggcagcaagggcctatcgttttgaactggttggatatacaagattcttttgatgcttctggttttaacctgattattcatgaagtcgctcataagctggacacccgtaacggcgatcgcgccagcggagttccctttattccgttgcgtgaggttgctggctgggaacacgatcttcatgctgcaatgaacaacattcaggaagaaatcgaattggttggcgagaatgcggcgagcattgatgcttatgcagccagcgatcctgctgaatgttttgccgtactttctgaatatttctttagcgccccagaactttttgctcctcgtttcccttcattgtggcaacgtttctgccaattttatcaacaagatcctttgcagagactgcatcacgctaatgatacagactcgttttcggcgacgaatgttcattaattaacaactttgcagattaattaaccaattgaaatgacttatgaaatttagtgttgacagacaaggtaccgctaagtaatattcgccccgttcacacgattcctctgtagttcagtcggtagaacggcggactgttaatccgtatgtcactggttcgagtccagtcagaggagccaaattctaaaaattcgcttttttagcgcaatgtcactgaccttagttgaacattgttttttaacggatagcgggtttttaacatcttaagcgccctcgacctttatggttgagggcgttttgctatgaacgccatcaccattttcccctcgattataaaacttgagttattcagtagtctcccctcttgcaactcacacccaaaactgcctaacgaaaagttattaattttcaatcatattgctatcagtatttacattttttcgctgtgctagaaagggcgcatttatgttagctcgttcagggaaggtaagcatggctacgaagaagagaagtggagaagaaataaatgaccgacaaatattatgcgggatgggaattaaactacgccgcttaactgcgggtatctgtctgataactcaacttgcgttccctatggctgcggcagcacaaggtgtggtaaacgccgcaacccaacaaccagttcctgcacaaattgccattgcaaatgccaatacggtgccctacacccttggagcgttggaatcggcccaaagcgttgccgaacgtttcggtatttcggtggctgagttacgcaaactcaaccagtttcgtacgtttgctcgaggttttgataatgtccgccagggtgatgaactggatgtcccggcacaagttagtgaaaaaaaattaaccccgccgccgggtaatagcagtgacaacctcgagcaacagatagccagtacttcacagcaaatcgggtctctgctcgccgaagatatgaacagcgagcaagcggcaaatatggcgcgtggatgggcctcttctcaggcttcaggcgcaatgacagactggttaagccgcttcggtaccgcaagaatcacgctgggcgtggatgaagattttagcctgaagaactcccagttcgattttctccatccgtggtatgaaacgcctgataatctctttttcagtcagcatactctccatcgtactgacgagcgtacgcagattaacaacggcttaggttggcgtcatttcactcccacatggatgtcgggcatcaacttctttttcgaccacgatcttagccgttaccactcccgcgccggcattggcgcggagtactggcgcgactatctaaaattaagcagtaacggctatttgcgactgaccaactggcgcagcgcacctgaactggacaacgattatgaagcacgcccggccaatggctgggatgtacgcgcagaaagctggctacccgcctggccgcaccttggcggtaaactggtctatgaacagtattatggcgatgaagtggccctgttcgataaagacgatcggcaaagtaatcctcatgccataaccgctggacttaactatacccccttcccgctgatgaccttcagcgcggagcaacgccagggtaaacagggcgaaaatgacacccgttttgccgtcgattttacctggcaacctggcagcgcaatgcagaaacagcttgacccgaatgaagtcgctgcacggcgtagccttgcaggcagccgttatgatctggtggatcgcaacaacaatatcgttctggaatatcgcaaaaaagaactggttcgcctgaccctgacagaccccgtgacagggaagtcaggagaagtgaaatcactggtttcgtcgctacaaaccaaatatgccctgaaaggctataacgtcgaagccaccgcactggaagctgccggtggcaaagtggtcacaacgggtaaagatattctggttaccctgccggcttaccggttcaccagtacgccagaaaccgataacacctggccgattgaagtcaccgccgaagatgtcaaaggcaatttgtcgaatcgtgaacagagcatggtggtcgttcaggcacctacgctaagccagaaagattcctcggtatcgttaagtacccaaacattgaacgcggattcccattcaaccgccacactgacttttattgcgcatgatgcagcaggtaatcctgttgtcgggctggtgctctcgacgcgtcacgaaggtgttcaggacatcaccctttctgactggaaagataatggtgacggaagctatacccagatcctgaccacaggagcgatgtctggcacgctgacgctgatgccacagctgaatggtgtggatgcggctaaagcccccgccgtggtgaatatcatttctgtttcgtcatcccgaactcactcgtcaattaagattgataaggaccgttatctctccggcaatcctatcgaggtgacggtagaactgagagatgaaaatgacaaacctgttaaggaacaaaaacagcaactgaataacgcagtcagcatcgacaacgtgaaaccaggagtcactacagactggaaagaaaccgcagatggcgtctataaggcgacctataccgcctataccaaaggcagtggacttactgcgaagctattaatgcaaaactggaatgaagatttgcataccgctggatttatcatcgacgccaacccgcagtcagcgaaaattgcgacattatctgccagcaataatggtgtgctcgccaatgagaatgcagcaaacaccgtctcggtcaatgtcgctgatgaaggaagcaacccaatcaatgatcataccgtcacgtttgcggtattaagcggatcggcaacttccttcaacaatcaaaacaccgcaaaaacggatgttaatggtctggcgacttttgatctgaaaagtagtaagcaggaagacaacacggttgaagtcacccttgaaaatggcgtgaaacaaacgttaatcgtcagttttgtcggcgactcgagtactgcgcaggttgatctgcagaagtcgaaaaatgaagtggttgctgacggcaatgacagcgtcacaatgaccgcgaccgtccgggatgcaaaaggcaacctgctcaatgacgtcatggtcactttcaatgttaattcagcagaggcgaaactgagccaaaccgaagtgaatagccacgacgggatcgccacagctacgctgaccagtttgaaaaatggtgattatagggttacggcctctgtgagctctggttcccaggctaatcaacaggtgaattttatcggtgatcaaagtactgctgccctgaccctcagtgtgccttcaggtgatatcaccgtcaccaacacagctccgcaatatatgactgcaaccttgcaggataaaaatggcaacccactaaaagataaagaaatcaccttctctgtgccaaacgacgtcgcaagtaagttctcgattagcaacggaggaaaaggcatgacggatagtaacggggttgcaatcgcctccctgaccggcacgttagcgggcacgcatatgatcatggctcgtctggctaacagcaatgtcagcgatgcacagccaatgacgtttgtggcggataaagacagagcggttgtcgttttgcaaacatcgaaagcggaaatcattgggaatggcgtggatgagacaactctgacagcaacagtgaaagatccgtcgaatcatccggtggcggggataacggtaaacttcaccatgccacaggacgttgcggcaaactttacccttgaaaataacggtattgccatcactcaggccaatggggaagcgcatgtcacgctgaaaggtaaaaaagcgggcacgcatacggttaccgcaacgctgggtaataacaataccagtgattcgcagccggtaacatttgtggcggacaaagcctcggctcaggttgtcctgcagatatcaaaagatgagatcacaggtaatggcgtcgatagcgcaacgctaactgcaacggttaaagatcagttcgacaatgaggtgaataatcttccggtaacattcagctcagcctcttcaggactcaccctgaccccgggagtaagtaataccaacgagtctggcatcgcgcaggccactctcgcaggcgttgcctttggtgagaagacggttactgcatcactggctaataatggtgccagcgacaacaaaactgtgcattttattggcgacacagcggcggcaaaaattatcgagttggcgcctgtcccagacagcataatcgccggtaccccgcagaacagctccggcagcgtcatcaccgccacagtcgttgataataatggctttccggtgaaaggtgtgactgtgaacttcaccagcaacgcagcgacagccgaaatgacgaacggcggtcaagccgtgacgaacgaacagggtaaggctaccgtcacttataccaatacccgctcctcgatagaatcaggagcgagaccggataccgttgaggccagtctggaaaatggtagctccacgcttagcacatcaattaatgtcaacgctgatgcgtctacggcacatctcaccttgctacaggcactttttgatacagtctccgcaggcgagacaaccagtctgtatattgaggtgaaggataattacggcaacggtgtcccccagcaggaggtaaccctcagcgtttcaccaagtgaaggcgtgacccccagtaataacgctatatatactaccaaccacgacggcaatttttacgcaagctttaccgctacaaaagccggggtttatcaattgacggcaaccctcgaaaatggcgattcgatgcaacaaacagtgacctatgtgccgaacgtcgcgaatgctgaaatcacgctggcagcctcgaaggatccggtgattgccgacaataacgatctcacgacactaacagcaacagtcgctgatacagagggcaatgcgatagccaacactgaggtaacatttactctgccggaagatgtgaaggcgaacttcacgctgagcgatggcggtaaagtgattactgatgctgaaggcaaagcgaaagtcacgctgaaaggtacaaaagcaggcgctcatactgttacagcatcgatgactggcggtaagagtgagcagttggtggtgaactttattgcggatacgctcactgcgcaggttaatcttaacgttaccgaggacaattttatcgctaataacgtcgggatgaccaggctgcaggcaacagtgactgatggaaacggcaacccgttagccaatgaggcggtgacattcacgctaccggcagatgtgagcgcaagctttactctcggacaaggcggttccgccattactgatatcaacggcaaggctgaagttacactgagcggtacaaaatccggcacctaccccgtgacagttagcgtgaacaattatggtgtcagtgatacgaaacaggtgactttgattgccgatgctggtaccgcaaaactagcctccttaacctctgtatactcattcgtcgtcagcacgaccgagggcgcaaccatgacggcaagcgtcactgacgctaacggcaacccggtagaaggcataaaagttaatttccgcggaacctccgtcacgctaagcagcaccagcgttgaaacggatgatcggggtttcgctgaaattcttgtgacaagcaccgaggtcggactgaaaacagtttcagcctctctggcagataaacctactgaagtcatctcgcgattactgaatgccagtgcagatgttaattctgcgacgattaccagtctggagataccggaaggtcaggtaatggtcgcacaagacgtagcagttaaagctcacgttaacgaccagtttggcaacccggttgcgcatcaacccgtgacattcagtgcagagccatcctcgcaaatgatcatcagccagaatacggtctctactaatacgcagggtgtagccgaggtcaccatgacgcccgaaagaaacggttcgtatatggtgaaagcatccctgccgaatggagcctcacttgagaaacaactggaggctattgatgaaaaactgacactcacggcgtccagtccgcttatcggtgtctatgcccctacaggcgctactctgacggcaacgctaacctctgcaaatggcactccagtggagggtcaggtcatcaactttagcgtaacgccagaaggggcgacgttaagtggcggaaaagtgagaactaactcttcaggtcaggctccagtcgttttgaccagcaataaagtcggtacatatacggtgactgcatctttccataacggcgtaacaatacagacacagacaaccgtgaaagtcactggcaactcaagcaccgcccatgttgctagctttatcgctgatccatcgactatcgccgccaccaacactgatttaagtaccttaaaggcaacggttgaggatggcagtggtaacctgatcgaaggtctcactgtgtacttcgccttaaaaagcggctctgccacattaacgtcattaacagcggtgaccgatcaaaacggaatcgcgacaacaagcgtgaaaggagcgatgacaggtagcgtcacggtaagcgcagtcacgaccgctggtggaatgcaaacagtagatataacgctggtggctggcccggcagacacctcgcagtccgtccttaagagcaatcggtcatcactgaaaggggactataccgatagtgctgaattacgtcttgttctgcacgatatatcaggcaatccgatcaaagtttctgaagggatggaatttgtgcaatcaggtactaacgtgccctatataaaaattagcgcaattgattacagtctaaatatcaacggtgattacaaagccactgttacaggaggcggagagggtatcgcaacgctgatccctgtattgaatggtgttcatcaagctggtctgagtaccacaatacaattcactcgcgcagaagacaaaataatgagcggtacagtatcagtcaatggtactgacctaccgacaactacattcccttcgcaggggttcaccggggcgtattatcagttgaataatgacaactttgccccaggaaaaacggcggctgattatgagttttcaagctctgcctcctgggtcgatgttgatgctaccggtaaagtgacatttaaaaatgtcggcagcaattcggaaaggattacggcgacgccaaaatcaggaggccctagctatgtatacgaaatccgtgtgaagagttggtgggtgaacgccggcgaggctttcatgatatacagccttgctgaaaatttttgcagcagcaatggctacacgctccccagagcaaactatttaaaccactgtagttcccgaggcatcgggtcactgtacagtgaatggggagatatggggcattacacgactgacgctggttttcaatcaaatatgtattggtcatctagtcccgcaaactcaagcgaacaatacgtagtttccctggcaacaggtgatcaaagcgtatttgaaaagcttgggtttgcttatgcgacatgttataaaaacctgtgattttccgttataatttcttaaagagtgttccattcggggcactcttttttacattccctctacagaactagcccttctctcacagaaaatgaataaataaaaatgcggcaccgccagaatcgcgttcgatgtgactatgatcattttcggtgagtactgctttgatctaaaggctggttttctgtgatgattgaccagcctcagagtattgatgacaccaccgttcataacagatcggcattactatgcataagtactgtctcatattctcgccaaaacactttttaatgcctttgcgaattcatccagacttatattgtcaattttttgcccaacgacgactgactccgagacatcggccattgcgggccatcgcgttttgtaatcagcataaattgcaacaacaggggtattataggcacttgccatatgtaatattgaggtgtcaggagttattgcgatataagcatcttttatgattgctgctgaacgtttaatcgagggtggtaaggataaacggtagacattattataacaatccactaatgccctggctttatcttcacctttgggtccatgaacgatcactattggtatatctgtttcactttaaatttttgctattagattttctgcaatcgataatgaaaatgtacgttcctgcgagctaccttctaaattgaacgcaatgtaagatcctaacgatcgcatttcctcgcgcacctcatcgagtacatcctcacttagtggcaattcatatattggcctgactgctggaaaacccgcctcacgcatcataaatgcccatgtcataggtacgggagcccggagtttctgatccatactggacgcgttcttgcacaaaggggagaagcaattcatggttataccaacaacctgaaaattcgtttttgctttcaactgactgataaataacatcgttttcaggttctttttacgcatcccctcaatgcaaagatccggcgtaccgtattgctgtgttatgttctttgctaaatcttttatttcttttaatgttgcgtgatcctgcatagtcattgtgactaatgttaatttagtctgttcaagtttaagcgcattaaagacttctaaattaattgtcgacgttacaattaaaagatgcttaattttatgcaattcaagcgcccgaataacaggaaagatggccatagcatcgccaatctgatcgggaatatggatgacaacaaagtctgttttttcaatattgaaattataagctttataatcgtagtaactaaatgcaatacgtctcaacaatgatgctaaaaacatacctaacctcgcctccctactggttataatgcaatgcagtctatcagactcatcagggtgccattttgtgcatatgcggacttttatgtttcatatctctaacctgtgggtcctctgcttaatccttaaacaacaccagcaactcctgcgctttcatcttccatcgaatttttcatgttgccgctaatcagccataaaatcatttgcagatgcgctctgtcgaggtagtctcataaggttcgtttatagatcgacggcaatgtgagttaccttttccatactaattataaaaagacagtacaaacaggatcattatggactccacgctcatctccactcgtcccgatgaagggacgctttcgttaagtcgcgcccgacgagctgcgttaggcagcttcgctggtgccgtcgtcgactggtatgattttttactctatggcatcaccgccgcactggtgtttaatcgcgagtttttcccgcaagtaagcccggcgatgggaacgctcgccgcatttgctacctttggcgtcggatttcttttccgtccgctcggcggtgtcattttcggtcactttggcgaccgactgggacgtaagcgcatgttaatgctgaccgtctggatgatgggcatcgcgacagccttgattggtattcttccttcattctcgaccattgggtggtgggcacctattttgctggtgacactgcgtgccattcagggatttgcagtcggcggcgaatggggaggcgcggcgttgctttccgttgaaagtgcaccgaaaaataaaaaagccttttacagtagcggtgtacaagttggctacggtgtaggtttactgctttcaaccggactggtttcattgatcagtatgatgacgactgacgaacagtttttaagctggggctggcgcattcctttcctgtttagcatcgtactggtactgggagcattgtgggtgcgcaatggcatggaggagtccgcggaatttgaacaacagcaacattatcaagctgccgcgaaaaaacgcatcccggttatcgaagcgctgttacgacatcccggtgctttcctgaagattattgcgctacgactgtgcgaattgctgacgatgtacatcgttactgcctttgcacttaattattcaacccagaatatggggctaccgcgcgaacttttccttaatattggtttgctggtaggtggattaagctgcctgacaattccctgttttgcctggcttgccgatcgttttggtcgccgtagggtttatatcacaggtacgttaatcggaacgttgagcgcatttcctttctttatggcgcttgaagcacaatctattttctggatagttttcttctccataatgctggcaaacattgcgcatgacatggtggtgtgtgtgcaacaaccgatgtttaccgaaatgtttggtgccagttatcgctatagtggcgctggagtcggttatcaggttgccagtgtggttggcggtggatttacaccttttattgccgctgcactcatcacttactttgccgggaactggcatagcgtcgccatttatttgctggctggatgcctgatttccgcaatgaccgctttgttgatgaaagacagtcaacgcgcttgatagcctggcgaagatcatccgatcttcgccttacacttttgtttcacatttctgtgacatactatcggatgtgcggtaattgtatggaacaggagacacacatgaataataagggctccggtctgaccccagctcaggcactggataaactcgacgcgctgtatgagcaatctgtagtcgcattacgcaacgccattggcaactatattacaagtggcgaattacctgatgaaaacgcccgcaaacaaggtctttttgtctatccatcactgaccgtaacctgggacggtagcacaaccaatccccccaaaacgcgcgcatttggtcgctttacccacgcaggcagctacaccaccacgattactcgccctactctctttcgttcgtatcttaatgaacaacttacgttgctgtatcaggattatggtgcgcatatctcagtgcaaccctcgcagcatgaaatcccttatccttatgtcatcgatggctctgaattgacacttgatcgctcaatgagcgctgggttaactcgctacttcccgacaacagaactggcgcaaattggcgatgaaactgcagacggcatttatcatccaactgaattctccccgctatcgcattttgatgcgcgccgcgtcgatttttccctcgcacggttgcgccattataccggtacgccagttgaacattttcagccgttcgtcttgtttaccaactacacacgttatgtggatgaattcgttcgttggggatgcagccagatcctcgatcctgatagtccctacattgccctttcttgtgctggcgggaactggatcaccgccgaaaccgaagcgccagaagaagccatttccgaccttgcatggaaaaaacatcagatgccagcatggcatttaattaccgccgatggtcagggtattactctggtgaatattggcgtgggaccgtcaaatgctaaaaccatctgcgatcatctggcagtgctacgcccggatgtctggttgatgattggtcactgtggcggattacgtgaaagtcaggccattggcgattatgtacttgcacacgcttatttacgcgatgaccacgttcttgatgcggttctgccgcccgatattcctattccgagcattgctgaagtgcaacgtgcgctttatgacgccaccaagctggtgagcggcaggcccggtgaggaagtcaaacagcggctacgtactggtactgtggtaaccacagatgacaggaactgggaattacgttactcagcttctgcacttcgttttaacttaagccgggccgtagcaattgatatggaaagtgcaaccattgccgcgcaaggatatcgtttccgcgtgccatacgggacactactgtgtgtttcagataaaccgttgcatggcgagattaaacttcccggccaggctaaccgtttttatgaaggcgctatttccgaacatctgcaaattggcattcgggcgatcgatttgctgcgcgcagaaggcgaccgactgcattcgcgtaaattacgaacctttaatgagccgccgttccgataataagttctgaaccttcttatcagaaatagatgtgaaggagtaagtaagacacctggcaaatagcctgcaataatcgtgggctgtttgcttccttgggcggatacgagttttattatcgtcttaatgatttccacatattaaaagcaagtatgctttcaaaacacaattataaaaaatcccgccaacaatataagtttttataaaattaaatataagattatggctttagaatatttttatttctaatagacgagatttttcctgttatgatataatatgctgaattaacacatgttaacgatttaccagtaatgtaaataaattttcgaggagatcattccagtgggacgtaaatgggccaatattgttgctaaaaaaacggctaaagacggtgcaacgtctaaaatttatgcaaaattcggtgtagaaatctatgctgctgctaaacaaggtgaacccgatccagaattaaacacatctttaaaattcgttattgaacgtgcaaagcaggcacaagttccaaagcacgttattgataaagcaattgataaagccaaaggcggcggagatgaaacgttcgtgcagggacgttatgaaggctttggtcctaatggctcaatgattatcgccgagacattgacttcaaatgttaaccgtacgattgctaacgttcgcacaattttcaataaaaaaggcggcaatatcggagcggcaggttctgtcagctatatgtttgacaatacgggtgtgattgtatttaaagggacagaccctgaccatatttttgaaattttacttgaagctgaagttgatgttcgtgatgtgactgaagaagaaggtaacattgttatttatactgaacctactgaccttcataaaggaatcgcggctctaaaagcagctggaatcactgagttctcaacaacagaattagaaatgattgctcaatctgaagttgagctttccccagaagatttagaaatctttgaagggcttgttgatgcccttgaagatgacgacgatgtacaaaaagtttatcataacgtcgcaaatctctaattatcttttaaagaaatctgtctttacggcagatttctttaatctcatataattcttataaaaaatataatattcaactcgtcatattgattatacccccccgttcccagagaaataatatttattaaaattccagttcttctttttctgattacagaaggcaaagtggcaattacgcatagtttcccgataaagacgcgatagcgacatcccgcataaggcatttttctctttatctttgtacggtacttcatggaacagagtttttgaccttgcgaatcgtgatgtctgttggggagggacaatttgctcactgaagcgtgagactcgattaagcgcacgaaacacagaaatcaaaaaacccggtcacttttttacaaggtaaccgggtaaaaataatttttattttttaactgttttgagactcatagagatgtctcaaaactaaaatttggctcctctgactggactcgaaccagtgacatacggattaacagtccgccgttctaccgactgaactacagaggaatcgtgagaacgaggcgaatattagcgatgcccacccacaatgtcaaagcctgttttttaaatttgaaatcgtttgctgaaataatctgcattttgtcgtttattccgacacaactggctttttttcacacttttgcggctcgggtcgagggtatttccatagccaacgtccagtaaccattcgccagtaaaacagcacggcccgcacagcccagtcggcaaacattcccatccagacaccaaccacaccccagccaagcatgattcccagcacataaccgactacaacccgacaaccccacatgctcaacatcgaaacccacatggcgtaacgggcatcacgagcacctttaaatccagcgggtagcacccatgaggcggaccaaataggcataaataaagcatttagccaaatcagaatcacaacgacatgtttaacctgtggatcctgggtgtaaaacgatgccataaccccggcaaagggagccgttagccaggcgatggccgttaatccaagagtggaaagccagaacacatgccgcaactgaatctctgcttgcgctatctgccctacccccaaccttcggcctgtaatgatcgtagaagcagagccgagcgcacttccgggtaagttgataagagccgcaattgaaaacgcgataaaatttccggcaataacactggtccccatcccggcaacgaacatttgggttaataaccgaccactggtaaataacactgattcgacactcgcgggaataccaatccccatgacttcccagataatgctaaaattcagcggtttaaaatagctctttaacgaaatccttagcgcaggattaaaaccaatcgccagcacccacaaaattgcaactgcgccaatataacgagaaatggttaaacccagccctgccccgacaaatcccagtcccggccaggagaaaaggccgtaaatcaatatgccgctaataataatattaagaatattcaggctaccgttaatcaatagcggtattttcgtattccctgcaccacgaagtgccccgctaccaataagagtgatggcagctgctggataactgagtaccgtcagctccagataagtcaacgccagtgctttaacttctgtcgtggcatcacccgcgacgaaatcaataatttgttcgccaaaatgatgaataagcgttgccaacagtacggcaaacaacgtcatgatcaccaatgactgccgcgtcgccaccctcgctcgtcgtcgatcccgcttaccgagactaaatgccacaacgacagtagtaccaagatcgatagcagcaaaaaaagccataatgaccatattgaagctgtccgccaatcccacgccggccatcgcatcttttcccagccagctgaccagaaaagtgctcagaacccccatcaacaggacacaggcattctccatgaagataggaacagcaagcggggttatctcgcgccagaacaacactttgtagctcttgcgtttagcgtgccagcgagtgccgtgaacaacctggcgtaaagcagaggagatattcaaagccgaccttaattgcagaaagtgaaaccacatttcaaataatgagggagaatcagcaaagctgcaaagattttcgccaacaaattgtctgcaaatgcaacaaactgttgatagaaacggcaaacagttggggaatttaaaaatcgggtttgacaaaagatttttcgccgttaagatgtgcctcaacaacgattcctctgtagttcagtcggtagaacggcggactgttaatccgtatgtcactggttcgagtccagtcagaggagccaaattcctgaaaagcccgcttttatagcgggatttttgctatatctgataatcaatttcctcttcactgctttccatcacctgccgcttgatatcctcaactgacagtcctgcattacaaagttccagaaagcgccagacatagttacgctgaagttgtcctcgcttcagtcccaaccagacagtattagcatcaaaaagatgccgcgtatccaggcggattaaattctcttcctcttgttcgccactggattgctcggcaactaatccgatcccaagcccaagagcaacataggttttaatgacatcagaatcctgcgcacttaatacaatatctgccagcaaacctttgcgggcaaatgcgtcatcaatacgtgagcgccccgtaatcccctgtcggtaagtgattaacggccacttcgctattgattccagcgtcaatggtgaaatttgcgtcaagggatgatcgtgtggaacaagcaaactatggtgccaacgaaaccacgggaaggcgacgagctgcgggtcattactcaaacgctcgctggcgataccaatatcagcttcgccattttgcaacaatgtcgcaatttcctgtggcgtcccctggattagctcgagccgaacctccgggaaaagttcgcgaaaagctttaatgacctctggcaagctataacgtgcctgagtatgcgtcgttgcaatagtgagaacgccagacgtatcgttggtaaacaggtctgcaagccgacgaacattactggcttcattcagaatacgttctgcaatgaccagtaatgctttgcccggttcagtcatgcccagcagtcgcttacctcgtcgaacaaatatttcgatgccaagttcatcctccagttcccgaatatgacggctgacgcctgactgtgaggtaaaaagcatattcgcaacctctgtcaggttgtaatcctgacgtgcagcctcgcggattatctttagttgttggaaattcacggtaaactccgggcagttcagatttcccgttattgttaaagtctaatgcccggcataacaaataataaaaacccgcatcttattccatcccgatataacacttagctcaccaattgccactgccttttttccatcactggagaactaatcactgacattaacaactctttcactgcctgtgcctgtggcgataagttcgctctggcgggtaaatttaatgacaaagagagactcatggaaggagtggtaatgcgtgacatccacccatttactgcgccacataacgaacgcgcggccgattcgggtaatactgcaacgcccatgccgctggcaatcgctgcggtaagcgtggcaatagactcaatttcaccaataacttttgccgtgagtcgccgtagggaaaaagcctcatcaacacgaagtctaatagcactgtaatcactggggagaaagaggttcatttgcgcaatagcattcacatcaacgctttgccccgggcaatcttgagttcctaccagaaaaagatcttctttcagcaaagcctgactggatacaccagccacaggggaatgctcataaatcaccgccatatcgagttggtgatttatcaatttttcgttaagcactgcaccactattttcatgaagatagataacgatctccggaaattcagcgcgaaccgcctgtaataagggcatggtgatggatgacgcagcggttcctggtgcaaagccaatcgagacttgccccgataatgcctgaccaacgttatgcaccgccagttgggcctgttcacactgacgtaaaatggcccgcgcatgggtatagagaatttttccggcgtctgttggtgtaacgccccgctttgtacggatcaaaagttgttgatttaactcaccttccagtgtggcaacctgctggctgagcgctggttgtgcgatatgcaatacttcagcagcctgggtcaggctaccaatatctacaatttttacgaagtatttcaggcgtctgaagttcatgttgcctccggtttttaagaatcggcccaagtgccgccattacttacaaccagattgcaagatgcttgccagttttattttggtgttgatgtacaagctaaccaactgtcaaataagagattatgatagattcgtcatttgctcctttaatcagctgtcgcgttcccctgccctataaaaggagggtatgcaccacgatggttcattacccaataagattgaaagctcaccactttgttgaaattgacagcaaacaaacaaaaaaatgcatttcaccctttgacatcaccatgcactgccattaatatgcgccccgttcacacgattcctctgtagttcagtcggtagaacggcggactgttaatccgtatgtcactggttcgagtccagtcagaggagccaaattcaaaaaagcctgctttctagcaggctttttgctttctaattaccaacgctcttaaaacatctgtcttgaaccagaactaatttgcacaggcattcccgatcgacgttgcaacgcagcatttgcgcgatttacatcaacttcttgcccgttgataaacgcccgcaaagatggggttaccggcaatggcacttttcggtcagactcatattctgcacgattgcgcgacaatggctcatgaacttccagccagttcgagccatctggttcagtggtgtattttactggctggtcgataatttgcacacgcgtcccaacaggaacattatcaaacagatatttgatatcgtcattgcgcagacgaatacagccctgacttacccggagcccaataccaaaattggcattggtaccatggatggcatacaacctgccaatataaatcgcgtacagccccatgggattatcggggcccgcaggaacaaatgcgggcaaactctcccctcgtttcgcatattcgcgccgagtgttcggcgttggcgtccaggttggagcttcttgtttacgttcaacggtagtcacccagttacgcggggtttctcgcccagcctggccgataccaataggaaagacttccacagtattactgtctggtgggtagtaataaagacgcatctcagcgacgttaacaacaatccctttacgaacagtgtcgggcaaaatcagttgctgcggaatggtgagttgcgagccagacttcggcaaaaaaacatcagcgcccgggttcgcttccagcatgttacttaacccttgcccgtattgtgcggcaaaagtctccagcggctgggtattgtgatcaggaacagttacagtaaacgactgccccactaaacggctaccctctggaggtaatggataagttaccgccaggctagtatggctggcaaaaagcagagcaaatgagcaaagaatatttacacgacgcatcatgtccctttcctatgtcgcgaaagctatccgttaagtatagcttttatcagacttttcgtttttaactgttcaaatcagaagtcgtattccccggtagaacaatattactggcagcaagttcgcccatgttgttgtatatcgcacaggcagcttcgatgatgggcatcgccagagctgcgccactcccctcacctaaacgcatctccatattgagataaggctccagccccaaatgcgagagcgctatacgcgcgcctttttctgccgacaggtgagaaggaatgagatacggtttgatcgcaggagacatctggcaggctgcgagcgcagcagcataagaaagaaatccatccagcaacacgggtaaaccgcaggaagcagcacctaacatcactccagctattccgaccaaatcaaatccacccacttttgccaggacatcaacaccatcctgaggatttggttgattcaacgtaatcgcccgacgcacaacatcaattttattagccagtttatctgtcggcaggtttgcgccaatcccaaccacttcttcaggatcccggccagtgattgtgctgactattgctgctgccggtgtcgtgtttgccatccccagttcacctacaccaaacagcgtgacaccgttttttgccagctcctgcgtataacatatgacgtccaaaagcaacttttcagcctgacggcgactcattgccggagctgaagcaatattgccgctacctcgtgcgacacgcatgttgataagcccggggataggctcagcagtatcaataccaacatcaattacgtggacgttagcgcccgcttgttctgccagcacacacacgccggttgttccacgggtcatattttcagcctgtatggctgtcacttcttttggagaaatagcgaccccttcctcccagacgccgtgatcggcacacataaccagtaccgcttttttgcccacatgcggtatgccattcaaccccggcattcctgccagttgtatggcaagcacctccagctttcccaggctaccaacaggtttgagtaacccgtcaatatgccgttgtgcacgcgacatagcggtagaatcgatggctgggatcgtattcagtaaatcggcaagtatttgcatctcacgtctctttatagcagtgccagcaggaagaccagttcaccaagctctatggctgctcccagcgtatcgcccgtttgcccgcccagcgtacgtttgagaagctgaccgaggatgaaaatcgccaccatcgtcaccaccatagcagccacaccatgcatacccggcaataatacggcagcaaaaatagcggctaagccgagtgtgacgcaggtttgtcgcccatcaattttgccaatgaacacattgccaagcccttcttcccgcgcataacgatgacgatacatcaataatgcggcagtcccgcggctgaccgcacatgctgccgccagcgatgcaaggatcgattcgccacgcagagccaactcgcttaacaccagaatctttgccagtaccacaaaaatcaatgccagaccgccgtgggtgcctaaacggctatcacgcatgatttccaacatgcgatcgcggctacgtgcagaaaatacgccatcacaggtatcagcgaggccgtccagatggaatcccccggtcatcagcaccagcacaagtacgctaaacagtgccgccagtggtgcgccacaccatgcctgcagcaccatgaagaccagcccgctaatcgcgccaagcaataatccaatcaaaggaaaagtaataataccgcgagaataatgctcgaaatccagtccctgggaccagcgacgcggtacaggcagacgcgtaataaatgagagcatcgcccaaaataatttactcatttgatttttactccaatacccgaaaccaccagccatacttcatttgccgcagcggccaactgctgatttacccgcccggcaatatcacgaaaatgtcgtgccagacgactctccggcacaatccccattcccacttcgttagtcactaatacaacctttgcggggcaacgttggcaggcagcaatcaacgactgaatctcagcattaatcgcctgttccatcgcctgataatcccattcatcagggtctttatcgccgccataatcaaacaacagattagtcaccattgtggtaacgcattcaagcaacacaacctcattcgggttaatgtctgcatgaattaattcatcaagatgttgccagcgctccactgtgcgccagtgctccgggcggccttgccgatgatgttctatccgtgcagccatctcatcatcaaggatttgcgaggtagcgatatacagaacctgtgaagagtccccaataagcgcctctgcgtggcgactcttcccgctccgtgcgccccccgtcaccaaaatcatcataccgactcctgattcaaatgtatgatggtattcattgaacagaacaatggatcccccaccgttgctgaccgcaaaacatttacgcgattaatactgcgcgtaatataattaaaaatccagcattctcaatccattacgaaataagatggcattacggaatagccagactttctcgtgttaacgtccgacaaaatgcgtcattgacagcggtttctgtggattgacacatttcattcagataatgaattaatgctactgccggaacaaccagcaaacgggcattgtgttctgaaatccaggctattgattcaacgtcagcgacagatctgcgctgtaaaagaacttgtaaaacaacgtaatagaattatccggaatggtggcgactatgcactagggaaggtgcgaataagtggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccttggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgactaggctgtgggtcaggccgctcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttccatggctccagatgacaaacatgatctcatatcagggacttgttcgcaccttccctagaacaccacaatttcgctctctcggtaaggcactgtcacagcattcaacagaatgtgacttgccagatttattagcgccaccagatgtttaaccgggtaaccacgacccagtcggggatatattccatcttctcgctgacatcatcaagaataaaaaggtttatcacactcagagcaacgttcttcagcaggcgggataattcttcaacatttagaagatgtgttattaaaggcatacaaactggacgtattgtattttcttttggtggttgacctaaggtagcagtttatcctgatgcgctgagatttctgtaatatctacgtcaacattctcctcgaatagaaaatgcagccccggcaagtgattcacattttttaacaaaacgttgttagcgtgccattttcagaagctctccaagaaagcgaattcttttctcaaattctgcattctcagacacagctttctactccatggtaatggcccaaatacgaagttgctcaggatcattagtggtgctgagaagttaaataaccatgcggagtaccactcgtcatcacgtatttatatatcatgaagctattgttgtgttttgtacatcagtagatatattctgatatactccttttgctagacataacctttcacctgcttgcaaagcttctgtgttctgacattgccaaattgttgcaattctgtatccagccttctttcagtcatagcttcgggccgcgataagactcactgatctgaccctgattcctcttgcagactttatagaccaattaaaatgcagtttctgcaggtcaacgtctgaccatcattgtcatcactctggccattagagtaaccttctgcattcatccttttgtaaaaagtttatattagtatcagcaattaaccggacctgatactgatatgagtcttaccgcatatacggtcaatttcagcaattaattacattatccacgccaaagtatttgtcatcacaatgatggtaccttctttcagacaccattttttcaactccgttttccacggaccgcactcttatgtcaagagtgcggtccgtggatacaaccagagaccgactgacacgagtcagaggaaacgacggatatgttcagtcgtaaaatatctatcaaaaaacatgattaaggtcaaaaatgtttgatatttacaatttatgaagatgacaataattatagatatatgagaacataaatgaaaataattatcattacagtaatcatttgtactttgtattaatgagggatgaaatgttatataatataccttgtcgaatttatatcctttccactctgtcattatgcatttctgggatagtttctactgcaaccgcaacttcttcagaaacaaaaatcagcaacgaagagacgctcgtcgtgaccacgaatcgttcggcaagcaacctttgggaaagcccggcgactatacaggttattgaccaacaaacattgcagaactccaccaatgcctccatagccgataatttgcaggacatccccggagtagagataacagacaactccttggcaggccgtaaacaaatccgcattcgtggctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctagtggcgaagcatcctcccgtgttttaattctcattgatggtcaggaggtaacttatcagcgcgccggagataattatggtgtgggactgttgatagatgagtctgcgctggagcgtgttgaggtagtgaaaggtccatattccgtactgtacggttcacaggcaattggcggtattgttaacttcatcaccaaaaagggtgaatctccggactccctatatcacttaaattgatacaactttttagagtagtcattagtgaacagataattgataactcagaaccagtaaaatgcaaaagacgcaccacgctgggaaaatcgctgctattcagcagagttttgtatcgagaatggtggccagccacttattgctctcgcgtaagcgggtaccgtgacattctgcctgaacttgacctggtactgtggctgattaaagccgatgaccgtgccctgtctgtggatgagtatttctggcgacacatcctgcagtgcggacatcagcaggtgctgtttgtggtgacgcaggccgacaaaacggagccctgccatgaatgggatatggccggtattcagccttctcctgcacaggcacagaatattcgcgaaaaaacggaggcggtattccgtctgttccggcccgtacatccggttgtggccgtatcggcccgcaccggctgggaactggatacgctggtcagtgcgctcatgacagcgcttcccgaccatgccgccagtcccctgatgacccgactgcaggacgagctgcgcacggaatctgtccggtctcaggcccgtgaacagtttaccggtgcggtggaccggatatttgacacggcggagagcgtctgtattgcctctgttgcacgcacggttctgcgtgccgtccgtgacacggtggtctctgttgcccgtgcggtatggaactggattttcttctgaacctgtcgtgactgatgccctccctgactctgagtctgctcacaaaagcactgttttcgttactgtctctcttgtccgtgcaatagctcaataatagaataaaacgatcaatatctattttatcgatcgtttatatcgatcgataagctaataataacctttgtcagtaacatgcacagatacgtacagaaagacattcagggaacaacagaaccacaattcagaaactcccacagccggacctccggcactgtaaccctttacctgccggtatccacgtttgtgggtaccggcttttttattcaccctcaatctaaggaaaagctgatgaaacgacatctgaatacctgctacaggctggtatggaatcacatgacgggcgctttcgtggttgcctccgaactggcccgcgcacggggtaaacgtggcggtgtggcggttgcactgtctcttgccgcagtcacgtcactcccggtgctggctgctgacatcgttgtgcacccgggagaaaccgtgaacggcggaacactggcaaatcatgacaaccagattgtcttcggtacgaccaacggaatgaccatcagtaccgggctggagtatgggccggataacgaggccaataccggcgggcaatgggtacaggatggcggaacagccaacaaaacgactgtcaccagtggtggtcttcagagagtgaaccccggtggaagtgtctcagacacggttatcagtgccggaggcggacagagccttcagggacgggctgtgaacaccacgctgaatggtggcgaacagtggatgcatgagggggcgatagccacaggaaccgtcattaatgataagggctggcaggtcgtcaagcccggtacagtggcaacggataccgttgttaataccggggcggaagggggaccggatgcagaaaacggtgataccgggcagtttgttcgcggggatgccgtacgcacaaccatcaataaaaacggtcgccagattgtgagagctgaaggaacggcaaataccactgtggtttatgccggcggcgaccagactgtacatggtcacgcactggataccacgctgaatgggggataccagtatgtgcacaacggcggtacagcgtctgacactgttgtgaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccggtgccacctggaatatccccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggtggaagccattaacggtgccaccacggaggaaggggcctttgtccaggggaacaggctgcaggccggtgcctttaactactccctcaaccgggacagtgatgagagctggtatctgcgcagtgaaaatgcttatcgtgcagaagtccccctgtatgcctccatgctgacacaggcaatggactatgaccggattgtggcaggctcccgcagccatcagaccggtgtaaatggtgaaaacaacagcgtccgtctcagcattcagggcggtcatctcggtcacgataacaatggcggtattgcccgtggggccacgccggaaagcagcggcagctatggattcgtccgtctggagggtgacctgatgagaacagaggttgccggtatgtctgtgaccgcgggggtatatggtgctgctggccattcttccgttgatgttaaggatgatgacggctcccgtgccggcacggtccgggatgatgccggcagcctgggcggatacctgaatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtatacctggcagggactttccctggatgacggtaaggacaacgccggttatgtgaagttcgggcatggcagtgcacaacatgtgcgtgccggtttccgtctgggcagccacaacgatatgacctttggcgaaggcacctcatcccgtgcccccctgcgtgacagtgcaaaacacagtgtgagtgaattaccggtgaactggtgggtacagccttctgttatccgcaccttcagctcccggggagatatgcgtgtggggacttccactgcaggcagcgggatgacgttctctccctcacagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttctgacagaaccatcgcctctctgtggtcccggtcatcatgaccgggacccggaccggcgcaacggatcttcaacgccacattcgctggcattaacaataacatgatattcatcacggagtgactatgttacagatagtcggcgcgctgatcctgctgatcgcaggatttgccattcttcgccttttgttcagagcattaatcagcacggcttctgcgctggcagggctcatattgctgtgtctgttcggcccggccttactggctggctatatcaccgaacgcataacccggttgttccatattcgctggctggcaggcgtatttctgacgattgccggaatgatcatcagcttcatgtggggacttgatggtaaacatatcgcgctggaggctcacacctttgactctgtgaaatttattctgaccaccgctctcgccggtggtctgctggctgttcccctgcagatcaaaaacattcagcagaacgggatcacaccagaagatatcagcaaggaaattaacgggtattactgctgtttttatactgcctttttccttatggcgtgttctgcatgcgcaccattgatcgcgttacagtacgatatttcaccgtcactgatgtggtggggcgggttgttgtactggctggctgcattagtgacgctgctatgggcggccagccagatccaggcgctgaaaaaactgacctgtgccatcagccagacactggaagaacaaccggtgctcaacagtaaatcgtggctgaccagtttgcaaaacgattacagccttcctgactcactgacggagcgcatctggctgacgctcatttctcaacggatttcccggggagagctgagggaatttgaactggcagacggaaactggttactgaacaatgcctggtatgaaagaaacatggcagggtttaacgaacagttgaaagagaacctgtcattcacacctgatgaactgaaaacgctcttccggaaccgcctgaatttatcaccggaagcgaatgacgattttctcgatcgttgcctggacggcggtgactggtatcccttttcagaaggtcgccgttttgtatcattccatcacgtggatgagcttcgtatctgtgcctcctgcgggctgacagaagtacatcatgccccggaaaatcataagccggatccggaatggtactgctcctctctttgtcgcgaaacagaaacactgtgtcaggaaatttatgaacgcccttacaacagctttatttccgatgcaacggcgaatggtctgattctcatgaaactgccggaaacctggagtacaaatgagaaaatgtttgcttccggagggcagggacatgggtttgccgctgaacggggaaaccatattgtcgacagagtccgtctgaaaaacgcacggatcctcggtgataataatgccagaaatggagcagacagactggtcagcggaacagaaatccagacgaaatattgttcaactgcagcccgtagcgtcggtgcggcattcgacggacaaaacggacagtatcgttacatgggaaataatggccccatgcaactggaagtcccccgtgatcagtatgccggcgctgttgaaaccatgaggaataagatccgcgaaggtaaagtagaggagagatgacgcccggcgagcgcagcctcattcaacgggccctgaaaaccctggaccgccatcttcatgaacccggcgtggccttcacctccacccgtgcagcacgggaatggctgattctgaacatggcgggactggagcgtgaagaattccgggtgctgtatctgaacaaccagaatcagctgattgccggtgaaaccctcttcaccggcaccatcaaccgcacggaagtccatccccgggaagtgattaaacgcgccctgtaccacaatgccgctgccgtggtactggcacacaatcacccgtccggtgaagtcacacccagtaaggcagaccggcttatcaccgaacgtctggtacaggcactgggcctggtggatatccgggtgccggaccatctgatagtcggtggcaaccaggttttctcctttgccgaacatggtctgctttaacccttcacaaccacatcacacctgttttcacttttatcttctgtcttcagaggtatcccattatgaaaattatcacccgtggtgaagccatgcgtattcaccaacaacatccgacatcccgtctttttccgttctgtaccggtaaataccgctggcacggcagtgctgaagcgtataccggtcgtgaagtgcaggatattcccggtgtgctggccgtgtttgctgaacgccgtaaggacagttttggtccgtatgtccggctgatgagcgtcaccctgaactgagtgggaattctgatgagcagaattatcgccactaccggaccattcttagccgattttctgtaaggattttatcgtgtcagacacactccccgggacaacacttcccgacgacaatcacgaccgcccctggtgggggctgccctgcaccgtgacgccctgtttcggggcacgtctggtgcaggagggtaaccggttgcattaccttgccgaccgcgccggtatcagaggcctgttcagcgatgcagatgcgtaccacctggaccaggcctttccgctgctgatgaaacaactggaactcatgctcaccagcggtgaactgaatccccgccatcagcataccgtcacgctgtatgcaaaagggctgacctgcaaagccgataccctcagcagttgtgattacgtttatctggctgtttatccgacgcccgaaatgaaaaattaactctccagaatagccttctgctacggcctggtgttttcaccacgccacttttccatttttatatctgcatatcaggaaaatcttcagtatgaaaacattacctgtattacccgggcaggcggccagttctcgcccgtctcctgttgaaatctggcagatactgctgtcccgactgctggaccagcactatggcctcacactgaatgacacaccttttgccgatgaacgtgtgattgagcagcatattgaggcaggcatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagtatccggaggcgaaatgatgacactggaagccgacagcgttaacgtacaggcgctggatatggggcacattgtcgttgacattgatggtgttaatatcactgaactgattaataaggccgctgaaaacggttattcactccgcgtggtggatgaccgtgactctaccgaaacaccggcaacttatgccagccctcaccagttgctgtaagacaatgcagtgatacagggtatagtgccattaaccacagaaacagcactgttgtcctgtattaagcaggcaagagaagatgtccttaccctgcgccatctgcagcttctgcaccagaaccggtgaatctcactcaacaggcttcatttctcctgacgccagcctgaatacagctggcgttttcatttataaacagaaaggaaaaccgataataatggaatggacgccccgaccatgaagcaacggtaggatattactgataaaccttccagtggaggtgcgttatggccgttttaacgattagcattgacctgacaaaaaatgaattccaaatccacggtctgggtaggaacagaaaaatctaagctcagaaaacggattaaagtaagcgtcaacggagcaccgtattgacgcttatttattggtgagaactacgttccatggcaggagttcgtcaacacggttggagggccattccggcagtatgctcagaatatggcgcagatacgcttccggatcgataccgttcagacggcaggtgcctgcttttctggcaacaagcaggaatctcagcgctgaagcaggaattagaggtaaaaacgccctaccgggccatgaatcacccggtcattggagtagtaaccaaagcagatttagccagcatggaacaaatatctttggtgaaaagttggttacgggaagctggagcgcacaacgtgttagtaaccagtgcagttaataacaatggagttacagaactttttgccttgctgcatacagaagaaggctgttgttaatttcgattggttctcggatgagaatgatgacggtgatacacagataagaatcaatgagcaatgagggttgccgggcaaccctcattgaataaaacgggaattacttcgcttcgccgtttttcatttcgcccatagctttcagctttttggagatatcgcggcgttctttggagagctcggcatttttgatgatgtaatcgtcaacgcgatcttcatagtcacctttcatgctggcgatgatgccctggattgcttcaacgctcatccccggcttgatgtaatcgctcaggttgtccagcagcaggacgcgcttctggttgtcacggatctttttctcaacgtcctgaatttcacgttgcagtttgttcttacgacggaacagacgaacaaattccagtacgtcctggaatgaaggcttggtagtttccatttttatacccctgataatgtgagagtcggattcgtttaagcaaccgctattcgttagggccaacattactcatagctgccgcagatgacaatgcttttatcccttttcactatcataccctttatccttgctgaatcgaagcagcagcaagatgattctgaagttcaggaattatttgcgcaaggcccggcaaatcagattcgatagcaactcaagctgatgcgccgtttccatgttcagccacacataaccatagattggtgtttccacaaccttcaggtcatggtggttattgagcaactgacgcagctcttccacagcatcgttcaatttttccgtattggcaaaaaccggctgcggattaccttcgtacagcgcatgaacaaggctcagcagtatttgctgcatcatgtgctgggtatcacgaagtttttgcgcgttcaataacacgaaatggctggggcgcgtggcccagtatgcattgatttgcaactccagcatacaaaccagattgcggttaatggtctggataccttcatatatcgattttggaatacgggtttctttgctggcgggcgcaatcagtccacgcattttcacggcatcggtcaggagtttttgtagatggctttccagacgtgggcgttcgagtaagttcggtgagaatgcagattgatagacccgattatactcggtcagacttttcgccagttgaatgcgccagtggatgaacgcccgttgtggccagataccggtaaacaacattgccagtaaagagccgaggatcacatcgccgcttcgccataacgccgtatcaatttcacctgtcggggaacccacaacaattgccagcgtcaccccaatcaataaaccttgatacggtttcttgcccagcgccagccaaccgcaaaggaacatggccgccgcgcaccagactaacatcagcggtaacgagattaactccagttgcagagcgataagacctaaaatcgaacccaacaccgtaccgccaatacgctcaaaggcgcgagggacaacgttaccccagaacgagattggccccataatcaccaccatggtgaccagcggccaggtgctttccgggatagtaaacaggcggataatgagaaaagtgagcaggaatgccagcgcgacccgagtaccatgcacaatgcggtaatggcggtatacccggatttcaaacgggcttaatgacttatcggcacgcacgcagaaactccgtaatgagattaaaagcgctcataactcatctgtcggccagaaggcgcgcctctgaattatccgacggacaaaccgggaacagtgtaatttcccggcaggagcgaaaaaattgaaaggcgcatcttactcttttcgctttcaaaaaaaagagtggtcatcgcgttaacacaccgccctgagatgaattagtgatgttttggctgcaccgcaacatacatttcgatatcccagtacccatcttccgcgccattgttcaaataaacctcgaagcagggctttggtaacatttcataagcactgtcctgcaagagactattaaagaactgataccagggtttagcaaaatcatcaccgactacacgagctaccgccaccgcatactgaccacctgtaatttctgtcagaatgacgccctcactgttttcgggaagcgtaaagtaacccggcaccgtcacgacggtgtcgcagcgtaatttttcggcgggtgtttcatctggattgtcgtaatagacagcaacccactccttcggcacaatatttttgctatctacccacatcatcaactgctcaaagcctttctttaccgtctgttcccacgggccaacgagatggaaacctgcaacggtacgtttctcttcctgcttaatctcgtagttcatgacgcctccattgatactgtttttatatacagtatagttgcaaaattaaaaccacaaggaatgagtgttgattatgcgagcagactcgcactcctgccagtctgctgcaaaagaaaggtcaggccttatggtggaaataatcactcaggcgagaaaacatgctgccttccccgacagattccagggtaaccagcggccagtgcgccacctgtttatcacggtcgtaaagttcaatttcccctacccgctgatgggcgctaattggcgcggtgagttctttaccatcaagggtatatttggctttgatatgtggaatttcggctttcggtagcaccatccagaactcttgttccgttcccaggtcgatattttctttatcgccataccagatgcgttccgttccgacctttttcccacggtgcaaaatttgcaccgtagtaaagttttgttgcccccaacgcagtaattttcttgcctcttcctcacgaccttttgcactgtcagcccccattaccactgcaatgagacgacgctgcccatctacagccgaagcaatgagattaaacccggcaccagaagtatgacccgttttcaggccgtcaacattcatggttttatcccacaacaacccgttacggttttgctgggtgataccgttccaggtgagacttttctcactgtacatatgataaaactcgggctcgccgtggatgatagcacgagaaagcacagctaaatcataagccgagctatgctggccaggtgcatccagaccatgcactgtttcaaaatgcgtatccttgagatgcagcttctcggcatagttgttcatcatttcaacaaactgccgttgcccaccggcaatatagtcagccagagcaacacaagcgtcatttccggaatccacaattaaaccacggcttaaatcacgtaccgatacgcgatcgccctctttcaaaaacatcagtgaagaaccgacaaacaccggattatctttcgcccacgcatcgcgccccacggtgacaatatcgtctggcgtaatgcgatgactatcgatagcgcgatccacgacataacccgtcatcagctttgtcaggctggcgggattgcgctgttgatgctcattacccgcggtgaggatctgaccggtggtgtaatccatcaatacccaggacccggcatgaatctctggaggctgaggtgaaaaaggaatgttttccgccgcaaaaccagacgataagttaaaaacgaacaaagaagcagcaataataagacggcgtttcaacagcaaaccctcaggagtttcaaatagctgttctttttacggaaatacttatgaactggctggaataaagtgcaagaaaatgtgactaccctctcatttttatctgacatgatctgttgccactcgctgccaaattgtggcgctaaagctgattagcacggtgatatttgatactctggcagacagcagaaataacggatttaacctaatgatgaatgacggtaagcaacaatctacctttttgtttcacgattacgaaacctttggcacgcaccccgcgttagatcgccctgcacagttcgcagccattcgcaccgatagcgaattcaatgtcatcggcgaacccgaagtcttttactgcaagcccgctgatgactatttaccccagccaggagccgtattaattaccggtattaccccgcaggaagcacgggcgaaaggagaaaacgaagccgcgtttgccgcccgtattcactcgctttttaccgtaccgaagacctgtattctgggctacaacaatgtgcgtttcgacgacgaagtcacacgcaacattttttatcgtaatttctacgatccttacgcctggagctggcagcatgataactcgcgctgggatttactggatgttatgcgtgcctgttatgccctgcgcccggaaggaataaactggcctgaaaatgatgacggtctaccgagctttcgccttgagcatttaaccaaagcgaatggtattgaacatagcaacgcccacgatgcgatggctgatgtgtacgccactattgcgatggcaaagctggtaaaaacgcgtcagccacgcctgtttgattatctctttacccatcgtaataaacacaaactgatggcgttgattgatgttccgcagatgaaacccctggtgcacgtttccggaatgtttggagcatggcgcggcaataccagctgggtggcaccgctggcgtggcatcctgaaaatcgcaatgccgtaattatggtggatttggcaggagacatttcgccattactggaactggatagcgacacattgcgcgagcgtttatataccgcaaaaaccgatcttggcgataacgccgccgttccggttaagctggtgcatatcaataaatgtccggtgctggcccaggcgaatacgctacgcccggaagatgccgaccgactgggaattaatcgtcagcattgcctcgataacctgaaaattctgcgtgaaaatccgcaagtgcgcgaaaaagtggtggcgatattcgcggaagccgaaccgtttacgccttcagataacgtggatgcacagctttataacggctttttcagtgacgcagatcgtgcagcaatgaaaattgtgctggaaaccgagccgcgtaatttaccggcactggatatcacttttgttgataaacggattgaaaagctgttgttcaattatcgggcacgcaacttcccggggacgctggattatgccgagcagcaacgctggctggagcaccgtcgccaggtcttcacgccagagtttttgcagggttatgctgatgaattgcagatgctggtacaacaatatgccgatgacaaagagaaagtggcgctgttaaaagcactttggcagtacgcggaagagattgtctaatttgaagcctccgccgctggtacggcggaggacaatgttgagtcaggctttttgaacggtgatgctccacgctgcatcgccaatctgctgataatcggtgatggcatgtccttcttctgccgcccactgtgggattgcttcagttgcctgggtgcaatcaaactcaatcactaactcatcgccgctgaccatttctgccagagctgcttttgcttctatgagtggaaacggacagacctgcgtcaccacatccagctttttaatcaccatctttacaccttacttaatttgccgcagcagttgccagtcgcgccttacgctgcggtcgaacatacacaagccaggacgcagtccagactccgagaatcataaatacaaggccaatccagccctgccaggtcatcattgcagtcataaccagtccattaccgatagagcaaccacctgcaatactggcaccgaagcccatcagtacaccacctaacccgctacgtaatgttgtttgtgcatcagctgcgcgaacgcggaactcacggctcgctttggctgcaataaatgaccccacgaagatccctaacaccaggaaaacgccccagttaatgtatttcatgtcacccgcgaccagaaattgcagaatattggccgttggggaagtgattcctaacccaaacatgcgtccggttgcttcactcaggggccaggctaaaagcgcaatcaaaccgatgagtacagctgtgacaaagggatgccagcgtttttcaaacagaatatgagcgatcccggttcggcgcggcggtaaggtcgcgactttgagttttggcttcttcaactctttcatcaccacccagagcgttatcaccagcaaaacggcaaccaacggccacacagacaaattaaaagtctcagcaatagagttatgttcagtactgtagtgctgcaaggtttgatttaaaccactggcatgtggagaacgcatcaccgcactcatcaccatataagtgaaaagcgcgatccaactgccgatcaatccctcacccgcgcgataccaggtcccggtggcacatccacccgccagaacaattcccagcccgaagatatacccacctataacagtaccaagccacgggaacgccccggcttcgtaagtcagtaggcccgcctgaattaacgcaaaaacccccacgctttgtaccgaaattgcaatcagcaaggcgtaaaacatgcgattatttttcacgatatacatatcgcgaaaaccacctgtcaggcaaaaacgcccacgctgcatgacaaatcccagcagagcaccacaaattagcccgcttaatatcattgaaaacataaattaattaaccagatgaatgttaatgaggaaattattcatgactggtggaatgcagaccaataaccaaattctctaaattagaacaaatggttattaatgaggagttcgatacaaaagaataaaaaaaccggagccaaatgttcattcgactccggtttattattagaaaagatgattatgctacgtcttcgtactgcggaaccggattacggaagctcttggtgacgcaagccaggtaaatcagaccgatagcagcccagatcagacccagaaccattgagctttcttccaggttaacccacagcgcaccaacggtcagcgcaccacacatcggcaggaacagatactggaagtgatctttcagcgtcttgttacgcttctcacggatccagaactgcgagatgaccgacaggttaacgaaagtgaacgccaccagcgcaccaaagttaatcagcgccgttgccattaccaggtcgaagttgattgccagcagggcaatcgcgccaaccaggatgatgttcatcgccggagtacgccatttcgggtgtacataaccgaagaagcttttcgggaatacgccgtcacgacccattacgtacatcagacgcgctacgcctgcatgcgccgccataccggacgccagtacggtaatggtggagaagatcagcgcgccaacctggaacgctttacccgcaacgtacagcatgatttcaggctgtgacgcatccggatctttaaagcgagagatatccgggaagtacagctgcaggaagtaagttgcaaagatgaagatcatgccgccgatcagcgcggtcaggaaaatcgcacgcgggatcacgcgctctgcatctttggtttcttccgacaggttgctgatgccgtcaaagccggtaaaggagaagcacaggattgtcgccccggtaatcatcgggataacatgcgcatcgccagaccagaatggacgagtgctcgccagcgtaccagcgccttcaccttcaaatacgccataaacaaccatgcccagaatcaccgcgatcagcactacctgcaacacgacgattacagtgttgaagttcgctacggatttcagactacgcaggttaaaggcggtcataaaggccaccagcgccaccacaaacatccacgatgggatggaaggcaccagagcttcaaaatagattttcgccagtagaatgttgatcatcggcgcgaacagatagtcgagcagagaagaccaacccaccataaagccgacagtcgggctaatggatttctgggcgtaagtgtatgcagagccagcagaaggatagcggcgaaccagcttcccgtagctcagagccgtaaacaggatcgcaatcaatgcgaacgcataggctgtcggcacatgaccatccgtgaggcctgaaacgataccaaaagtatcaaacagcgtcatcggctgcatataggcaagacccatcattacaaccggaactaacgtaagcgttttacgcaattccacgcgagaggtgtttggagtaacgttatgcgacatggtcattctcctttacggtgataaccgtcgcgtaagcaaaaaattgccccatttttttggattcctcagcgacaacaactgtcgatttttagtaaatatctatccggtacgaagcccggcctcttggtatgaatgattggtttgaagcaaaaaataaccgacgctgatgaaacgtcggtttttagtcattttttgacagcggcgcattgtgcctaaatgggggggaaatgacaagagaatgagaggcttgtcagaataatttttctttaaatggctgattttccgtcatcagattttgcataaacaccggcgatcgcactatttgctaaaatttcatcccgccaccagccactggcaagtcctgcggtctgttcgttccagccaatccagacgggttcaaagagagtttgggcgaccactttcttctcgattaacgcgccactatcgagaaaacgttgcgccagataacggggtaaatagccgcagccgaggccgctaatttgcagctccagtttggttttaaaatcgaaaacggtaatggcttcttgttcgtcgagaagttgtgatgccgtagaagcgcctgcctgcgcagtatcccccaccacaatcgcccgatatcgcttaataatacgacgatttaacggctcttcttccagggctaacggatgatgaggcgcgaccgcaaagacttgttccagatcgcccaaccgtgaaaaaccaaactcactggaagatggtggctcatgcatcgcgccaacaataatatccgctcgcccctgagtcagggcatcccatgaaccaccgagtacgccattgataaacttcaggcgcgtcacgctatgatgttgataaaaagcttcaatgagtggcgcaagcagagaaaaaggaaacgtgtcgtccacgccaatcaccagctcgttttcccagccttcatgcagtttgatcgcctgcttttccagttcccgcacggtatgcagaacttcccgccctttctctaataacatttttccggtgcgggtgaatttagcgcggtgtccgctacgatcaagcaattgaatattaaggtcgctttccagcttgtgaacggtgtaactcagagcggacggcgtcttgtagagtttggccgacgccgccgcaaaactgccttctttttctaaggcatcgaggatcatcaacacatccagcagtggtttcatacacgcccccttgcagtgcatgcggcgtcctgctggcgtgatcgtttactccagcggcattaccagcggatcgggatactggtattcaaatcccagttcattacaaatccgactgccatcaataatcttacctttgccgctgtccagactatttctgaactgcggaggttccagccccagtaaacgggccatctgcggatagaaaacattacgcgcagggtgagctggcgcacatatattatagatgtgtccgcctttaggtgcctgtaacaacagagtgatagcgccaataacatcttctaaatggactaaattaacaccatgttcaccatcaggcgcggtttttccggcaaagaagcgtccgggatgacgtcccggtccgaccaggcccgcaagacgcagaatatcgaccgaagtaccgggtaaattgtgcagccagtcttcgagttcttctaatactcgtccactgttggttactggattacgcggggtggtttctttcaccgtgccttgcgcgtcgccatagacagatgttgagctggtaaaaataatgcggggaatacgatgggccagcgcgctatccactaactcttgtaccgcttgtaaatagaactcatcgccggggccgctacgacgtgccggaagcgtaatgaccagcgcatcggcatccatcagggcatccagatcgtcagaatcgcaaactagctcaggctccatgcgaagcagatagctatcaatgccactcattcgggccgcttcgacaccatcttgtgtggttttactcccggtgacttgccagcctcgcgctgaaagtgacatcgccagcggcatgcctaaccaccctaacccgacaattgcgacctttttcatccgttatctcctgatacaccttagatctataaggctacgctagcgtatcaaaactgacaattcattctatgaatgaatctgttcaataatgataacgacatgctgcaatgagcagtgaatcgtcggtaaccgcgtataccagacggtgctcctctgtaatgcgtcgggaccagaaacctgacaaattatgtttcaggggttctggcttccccttaccttcaaatggcgttctgcgggtatctttgataagttcattgatctttttaacaattcgcttatctgtttcctgccagtacagataatcgtcccatgattcctcagaccagattagtttcactcaatgatgtccttttccgttcctttgcctgatttcaggctatcgattgagtccatcaatctccgggcgttagcgggggagcgcagtagataagccgtctcttccagcgagttgtattcttcgagtgacatcagaacacaagcctctccattctgacgagtaataaggatcggggcatgatcttcaacggctttcatcattgttgccgacaaattctgacgcgcttcgctgtagctaattgtacgcatgtcaatctcctcttttgtacagttcattgtacaatgatgagcgttaattaactatttattaattagtttgtagatcaaggtattgtcagtgagacgaaaatccaggcttcgctatttttggtgccatcagctaagaggacagtcctcttagccccctcctttccccgctcattcattaaacaaatccattgccataaaatatataaaaaagcccttgctttctaacgtgaaagtggtttaggttaaaagacatcagttgaataaacattcacagagacttttatgacacgcgttcaatttaaacaccaccatcatcaccatcatcctgactagtctttcaggcgatgtgtgctggaagacattcagatcttccagtggtgcatgaacgcatgagaaagcccccggaagatcaccttccgggggcttttttattgcgcggttgataacggttcagacaggtttaaagaggaataacaaaatgacagacaacactcgtttacgcatagctatgcagaaatccggccgtttaagtgatgactcacgcgaattgctggcgcgctgtggcattaaaattaatcttcacacccagcgcctgatcgcgatggcagaaaacatgccgattgatattctgcgcgtgcgtgacgacgacattcccggtctggtaatggatggcgtggtagaccttgggattatcggcgaaaacgtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatcgccctgctgccaggtgccgaacgcccaactattctgccgctggcgggtgaccaacagcgcgtagcgatgcacatggtcagcagcgaaaccctgttctgggaaaccatggaaaaactgaaagcgctgggtgccagttcaattctggtcctgccgattgagaagatgatggagtgatcgccatgagctttaacacaatcattgactggaatagctgtactgcggagcaacaacgccagctgttaatgcgcccggcgatttccgcctctgaaagcattacccgcactgttaacgatattctcgataacgtgaaagcacgcggcgatgaggccctgcgggaatacagcgcgaagtttgataaaaccacggttaccgcgctgaaggtgtctgcagaggagatcgccgccgccagcgaacgcctgagcgacgagctaaaacaggcgatggcggtggcagtaaagaatattgaaaccttccacactgcgcaaaaactgccgccggtagatgtagaaacgcagccaggcgtgcgttgccagcaggtcacgcgtccggtagcttcagttgggttgtatattcctggcggctccgccccgctcttctcaacggtattaatgctggcgactccggcgagtattgcgggctgtaaaaaagtggtgctgtgctcaccgccgccgattgccgatgagatcctttatgcggcgcagctgtgcggtgtgcaggacgtgtttaacgtcggcggcgcacaggccattgccgcactggcgtttggtacggaatctgtgccaaaagtggacaaaatcttcgggccgggtaacgcctttgtcaccgaagcgaaacgtcaggtgagccagcgtctggacggtgcggcgatcgatatgcccgcaggcccgtcggaagtgctggtgattgctgacagcggcgctacgccggatttcgtggcttctgatttgctctctcaggctgaacacggcccggactcacaggtgattttactgacgcccgctgctgatatggcgcgtcgcgttgccgaggccgtcgaacgccaactggcagaactgccgcgtgccgaaaccgcccgccaggcactgaacgccagccgcctgatcgtgactaaagatttagcgcagtgcgtggagatctccaaccagtacggcccggagcacctgatcattcagacccgcaacgcccgtgaactggtcgatagcatcaccagcgccggttcggtatttcttggtgactggtcaccggaatcggcaggtgattacgcctccggcaccaaccacgttctaccgacttacggttacaccgccacctgttccagcctcgggctggcagatttccagaagcgcatgaccgtacaggaactgtcgaaagaggggttctccgcgctggcttcaaccatagaaacactggccgccgccgagcgcctgaccgcccacaaaaatgccgttactttgcgtgttaacgcccttaaggagcaagcatgagcaccgtgactattaccgatttagcgcgtgaaaacgtccgcaacctgacgccgtatcagtcggcgcgtcgtctgggcggtaacggcgatgtctggctgaacgccaacgaataccccactgccgtggagtttcagcttactcagcaaacgctcaaccgctacccggaatgccagccgaaagcggtgattgaaaattacgcgcaatatgcaggcgtaaaaccggagcaggtgctggtcagccgtggcgcggacgaaggtattgaactgctgattcgcgctttttgcgaaccgggtaaagacgccatcctctactgcccgccaacgtacggcatgtacagcgtcagcgccgaaacgattggcgtcgagtgccgcacagtgccgacgctggacaactggcaactggacttacagggcatttccgacaagctggacggcgtaaaagtggtttatgtttgcagccccaataacccgaccgggcaactgatcaatccgcaggattttcgcaccctgctggagttaacccgcggtaaggcgattgtggttgccgatgaagcctatatcgagttttgcccgcaggcatcgctggctggctggctggcggaatatccgcacctggctattttacgcacactgtcgaaagcttttgctctggcggggcttcgttgcggatttacgctggcaaacgaagaagtcatcaacctgctgatgaaagtgatcgccccctacccgctctcgacgccggttgccgacattgcggcccaggcgttaagcccacagggaatcgtcgccatgcgcgaacgggtagcgcaaattattgcagaacgcgaatacctgattgccgcactgaaagagatcccctgcgtagagcaggttttcgactctgaaaccaactacattctggcgcgctttaaagcctccagtgcggtgtttaaatctttgtgggatcagggcattatcttacgtgatcagaataaacaaccctctttaagcggctgcctgcgaattaccgtcggaacccgtgaagaaagccagcgcgtcattgacgccttacgtgcggagcaagtttgatgagtcagaagtatctttttatcgatcgcgatggaaccctgattagcgaaccgccgagtgattttcaggtggaccgttttgataaactcgcctttgaaccgggcgtgatcccggaactgctgaagctgcaaaaagcgggctacaagctggtgatgatcactaatcaggatggtcttggaacacaaagtttcccacaggcggatttcgatggcccgcacaacctgatgatgcagatcttcacctcgcaaggcgtacagtttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcgcgaccgacattcaactggcggaaaacatgggcattactggtttacgctacgaccgcgaaaccctgaactggccaatgattggcgagcaactcaccagacgtgaccgttacgctcacgtagtgcgtaataccaaagagacgcagattgacgttcaggtgtggctggatcgtgaaggtggcagcaagattaacaccggcgttggcttctttgatcatatgctggatcagatcgctacccacggcggtttccgcatggaaatcaacgtcaaaggcgacctctatatcgacgatcaccacaccgtcgaagataccggcctggcgctgggcgaagcgctaaaaatcgccctcggagacaaacgcggtatttgccgctttggttttgtgctaccgatggacgaatgccttgcccgctgcgcgctggatatctctggtcgcccgcacctggaatataaagccgagtttacctaccagcgcgtgggcgatctcagcaccgaaatgatcgagcacttcttccgttcgctctcatacaccatgggcgtgacgctacacctgaaaaccaaaggtaaaaacgatcatcaccgtgtagagagtctgttcaaagcctttggtcgcaccctgcgccaggccatccgcgtggaaggcgataccctgccctcgtcgaaaggagtgctgtaatgaacgtggtgatccttgataccggctgcgccaacctgaactcggtgaagtctgccattgcgcgtcacggttatgaacccaaagtcagccgtgacccggacgtcgtgttgctggccgataaactgtttttacccggcgttggcactgcgcaagcggcgatggatcaggtacgtgagcgcgagctgtttgatctcatcaaagcctgtacccaaccggtgctgggcatctgcttagggatgcaactgctggggcggcgcagcgaagagagcaacggcgtcgacttgctgggcatcatcgacgaagacgtgccgaaaatgaccgactttggtctgccactgccacatatgggctggaaccgcgtttacccgcaggcaggcaaccgcctgtttcaggggattgaagacggcgcgtacttttactttgttcacagctacgcaatgccggtcaatccgtggaccatcgcccagtgtaattacggcgaaccgttcaccgcggcggtacaaaaagataacttctacggcgtgcagttccacccggagcgttctggtgccgctggtgctaagttgctgaaaaacttcctggagatgtgatgattattccggcattagatttaatcgacggcactgtggtgcgtctccatcagggcgattacggcaaacagcgcgattacggtaacgacccgctgccgcgattgcaggattacgccgcgcagggtgccgaagtgctgcacctggtggatctgaccggggcaaaagatccggctaaacgtcaaatcccgctgattaaaaccctggtcgcgggcgttaacgttccggtgcaggttggcggcggcgtgcgtagcgaagaagatgtggcggcgttactggaagcgggcgttgcgcgcgtagtggtcggctccaccgcggtgaaatcacaagatatggtgaaaggctggtttgaacgcttcggtgccgatgccttagtgctggcgctggatgtccgtattgacgagcaaggcaacaagcaggtggcagtcagcggctggcaagagaactcgggcgtttcactggaacaactggtggaaacctatctgcccgtcggcctgaaacatgtgctgtgtaccgatatctcgcgcgacggcacgctggcaggctctaacgtctctttatatgaagaagtgtgcgccagatatccgcaggtggcatttcagtcctccggcggtattggcgacattgatgatgtggcggccctgcgtggcactggtgtgcgcggcgtaatagttggtcgggcattactggaaggtaaattcaccgtgaaggaggccatcgcatgctggcaaaacgcataatcccatgtctcgacgttcgtgatggtcaggtggtgaaaggcgtacagtttcgcaaccatgaaatcattggcgatatcgtgccgctggcaaaacgctacgctgaagaaggcgctgacgaactggtgttctacgatatcaccgcttccagcgatggccgtgtggtagataaaagctgggtatctcgcgtggcggaagtgatcgacattccgttttgtgtggcgggtgggattaagtctctggaagatgccgcgaaaattctttcctttggcgcggataaaatttccatcaactctcctgcgctggcagacccaacattaattactcgcctggccgatcgctttggcgtgcagtgtattgtggtcggtattgatacctggtacgacgccgaaaccggtaaatatcatgtgaatcaatataccggcgatgaaagccgcacccgcgtcactcaatgggaaacgctcgactgggtacaggaagtgcaaaaacgcggtgccggagaaatcgtcctcaatatgatgaatcaggacggcgtgcgtaacggttacgacctcgaacaactgaaaaaagtgcgtgaagtttgccacgtcccgctgattgcctccggtggcgcgggcaccatggaacacttcctcgaagccttccgcgatgccgacgttgacggcgcgctggcagcttccgtattccacaaacaaataatcaatattggtgaattaaaagcgtacctggcaacacagggcgtggagatcaggatatgttaacagaacaacaacgtcgcgaactggactgggaaaaaaccgacggacttatgccggtgattgtgcaacacgcggtatccggcgaagtgctaatgctgggctatatgaacccggaagccttagacaaaaccctcgaaagcggcaaagtcaccttcttctcgcgcactaaacagcgactgtggaccaaaggcgaaacgtcgggcaatttcctcaacgtagtgagtattgccccggactgcgacaacgacacgttactggtgctggcgaatcccatcggcccgacctgccacaaaggcaccagcagttgcttcggcgacaccgctcaccagtggctgttcctgtatcaactggaacaactgctcgccgagcgcaaatctgccgatccggaaacctcctacaccgccaaactgtatgccagcggcaccaaacgcattgcgcagaaagtgggtgaagaaggcgtggaaaccgcgctggcagcaacggtacatgaccgctttgagctgaccaacgaggcgtctgatttgatgtatcacctgctggtgttgttgcaggatcaggggctggatttaacgacggtaattgagaacctgcgtaaacggcatcagtgagttgcggggtaagcggatgcgatattgttgccgcatccggcaaaaaaacgggcaaggtgtcaccaccctgccctttttctttaaaaccgaaaagattacttcgcgttgtaattgcgtagagcattacgccccagcacaatccccgcgccaaccatgccacccagcagcaccgccagaatcaaggtaattgcctttttcgggctatcacgacgaataggtaacatcggtttcatcacataacggtaagcatgaatatcaagatcatcaacttttaagctttcgatatccagcaggttttgacgagtctgatagtagtttggcgagaacaccaacggacgggtcgcctcatgcttaatcatcgactccagcgcttcgctccccaaaaggaacaacgtatcttgtgtgatatcttcgccagtctgttgaatctgcggttttgtcacctgcgcctgattcgcatactgcaacgcttcctgaatctgacggatacgcagatctttctgctcctgcgcgactacttcctgcgttcttaaagagtcctgcaagtttttccgtcccagagcaatgttgtctttgagatccttttctagctcttgattcactttatcgtcaacttgctgaatgtattgggccaacttcatttgtgcgccctctgcagtttgcccaacataagaaacagtcaatggtaattgctggttcttaacagaaggttcgatggtaagtttttctcgttcttcctgattatccagcgtttctgctaatgcagagaaggcagaactgaagcgaccaattaacgtctcctgcaaatccgatactttcggtgcagcctgaccatagataacattcatggcattgttatagccagcaatttgccccacgtcgggctgagtgataattgctgttgacgtccatttctccttcgctactgccaaatatccaatagccagggcaatagccacaatgacggaaatgatgattgtcatcttgccacgccacaactgcactagtaaatcaatcaaatcaatctgttccgggtcatggttttgcccagaaacattattattttctactctcatcattaccctaactgacggaaatttccaagtccgcatagtttagcgataatcctcgtgaatgctataggataagtgataaaaataatgaattgttgtgtaagtaacaaaagacaatcagggcgtaaatagccctgataacaagatgttagtcgctgccaaagagatcgcgggtgtataccttatctgccacatccttaagctcttctgccattcggttagagataatgacgtcggcttgttgtttgaaggtggcgagatcacgttccaggcgagagttgaagaatgagtcttctttcatcactggctcgtagatgatcacttcaacacctttcgccttgatacgtttcataatcccctgaatagaagacgcacggaagttatctgaaccgctcttcataatcagacgataaatacccaccacttgcggcttgcgtgacaaaatggcatcggcaataaaatctttacgcgtgcggttagcatcgacaattgccgagatcaggttattcggcacagactggtagttcgccagtaactgcttggtatctttcggcagacaataaccaccataaccaaacgacggattgttgtaatggttgccaatacgtgggtcgagacaaacgccttcgattatttgacgggaattcagacctaaactttctgcatagctatccagttcgttaaagtacgccacgcgcatcgccaggtaggtgtttgcaaaaagtttaatcgcttctgcttcagtggagtcggtaaacagcatcgggatattttgcttaatcgcgccttcctgtaacagagcagcgaaacgttctgcgcgttctgaacgctcaccgatgacaatacgtgaaggatggagattatcgtaaagggctttaccctcacggagaaattccggggagaatataatattttcagtgcgatatttcttatgcatcgctgcggtaaaaccaacgggaaccgttgatttgatgaccataaccgcataaggatttatctcaactacgtctttaattactgattctacactggatgtattgaaataattagttttaggatcatagtcggttggagtggcgatgatgacataatcagcatcccggtaggcttcatttttatctaatgtggcattaaagtgtattttatctgattgcaaaaactgctgaatttccttatcaacaataggagatatccgatcattcagcatagcaacgcgtgacggtaaaatatctaatgccacaacctcatgattttgtgcgattagaagcccgtttgacaagcctacatagccagtaccggaaatggtgattttcatttcatgctctcagaattaacttaactgtgaatcatgatgtttttagcatcctgataagagctaaaagttttaacgctacgttgttcgatggtcaacgcaacgaaaaacaattcagattttctttataagaatagctgatatttattaagttaatattaagcagtgaaatttagtctataagatatttggcaaaaaaaagcccggtgcaatatacgccgggcctcaattttattgttggttaaatcagattaatccagccattcggtatggaacacaccttctttatcaatacgcttataagtatgcgcaccaaaatagtcacgctgtgcctggatcaggttcgcaggcagaacagcagcacggtagctgtcgtaataggcaaccgctgcggagaaggtcggaaccggaataccgttctgtactgcataagcaacgacatcacgcagcgcctgctggtagtcatcggcaatttgcttgaagtacggagccagcaacaggttagcgatctgtggattttcggcataagcatcggtgattttctgcaggaactgcgcacggatgatgcagccagcacggaaaatcttcgcgatttcgccgtagttcagatcccagttgtactcttcagacgcagcacgcagctgagagaagccctgggcgtaagaaacgattttgcccagatacagcgcacgacgaactttttcgatgaactcagccttgtcgcctgctggctgtgcttgcggaccagagagaactttagatgcggcaacacgctgatctttcagagaagagatataacgtgcaaacacagactcggtaatcagcgacagcggttcgccgagatccagcgcgctctggctggtccatttaccggtacctttgttagccgcttcatccaggatcacatcaaccaggtagttaccgtcttcatcttttttggtgaagatatctttggtgatgtcgatcaggtaactgctcagttcaccgttattccactcggtaaaggtctgcgccagttcttcgttggtgaggttcaggccacctttaagcagagaataggcttcagcaatcagctgcatatcgccgtattcaataccgttgtgaaccatcttcacatagtgacctgcgccatcggcaccaatataggtaacgcatggttcaccgtcttcagctacggcggcgattttggtcaggatcggtgctaccaattcataggcttctttctggccaccaggcataatagaaggacctttcagcgccccctcttcaccgccagaaacaccggtaccgatgaagttaaagccctctgctgaaagctcacgattacgacgaatagtgtcctggaagaaggtgttaccaccatcaatgatgatgtctcctttatcgagatatggtttgagggaatcaatagcagcatccgtgcctgcacctgctttcaccattaacaggatgcgacgaggcgtttccagagattcgacaaactctttcaccgtatagtaaggaaccagtttcttgcctggattttcggcaatcacttcttccgtcttctcacgggaacggttgaaaatagagacggtataaccacggctttcgatgttgagcgcaaggttgcgtcccatcactgccataccgactacgccgatctgttgcttggacattacatactcctgtcaggtgtgatcaccgcgctgaatgctcgcggcctggaatgttcgcaaataagtatacaaagtacttattaaagtataaatagcttatccatgcttatatgcttacggctttatattacgggtgaaaaactgatgaaattcgatcaaagttgcgatttgataaaatacgttttctggctaaatatctaaaagtactttttaagtgccatctgaaggcttttgaaaaaaaacttcgattgtcatgatgagcataatgtatcgcatgaaaagcgggaacataatgaagtctgacaccagccaggctaagcctcaagcacaggtcaatatcttcacagtacataaagtaaccttgatcgaagccatttacacgcacaaaatctgaaaaacgtaccagcataaatgatcctgcgcaccaatcaacaaccgtatcagaatagatactttctttaggaatttttgttttattaaggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaatccctaacataaatgacacaataaaatcagaaagcacaggaaattttcttacggaataatcatgtaaagatttcgcttcatctcggaacaggcataatgtactaaaagcataacgcttactttcgacatatttaatatatgtcagcaaatcatcatgcttcatgatgatatcgggattcaaaaacaaaatgtaatcatcatctgcgggtctatatttttcctttacatacgccaccgcaatattattattatgaccaaagccgtatacacctccactaatatagtccaggcctgcataatgctggcatatttgtttcaataatagagagtctttgttgtcgcgtacgataatcttgtagtgctcatcgtcagcattaagattttcgagtaattttttgatgtagtcttcatgtccgtgggaaacgattattatatataccatttcaatgttcttcagtaataaaattaactagttcatcaaacccaactaatacattttcattacgataaatgaaatttgcatcagagatatcttttttgaggttaccttttttgaagtcaataataagtttaactaacatgtcatcgttattagaatcaaaaaaagctttcttttcataactaccaagagtttctctagtaaatgggaaatctgatgctaatacccacttacctcgctctttagcttcagacaacggcaatccccatgtttctaacctagagggaaaacaaactatatctgaaatattataacaatgatcgattttttctttatccaagtacccgaggaaatgaacattatccagtccttctgcaagactgataatatattttgcatacgcattttctgtaccactgatagtaagcagaaatttaatattggattgttctttcaatttccttgctgcactaataataagctcgtaatttttaaatactcgtggaacagcagggtaaaatattgtcaactcagaagggttattcttaaattgagaatcatcatcagtaagttggcttttatcagataatttaatttctggccgactgacaatgatgttatttatagaatatttcttgataaatttttctttcatccagaattgttgaacaaacactgcagtattttttttaatgtttattttatatatcagcccgtatagcattttaaataagaaaaagctaggctccataagaatttcacggaataaaattcctttataaaaaggtgcagggttatgacaatacacatatctttttttagtgacgacattggccgtaatatcatgcagacaaatccaatgcgtagcattcagctcttttgaaagttttttacaaactacatattcaaagtgcaaacgttttagccacgaccctttaacctcaggaaactcaatgaatttaacccatggataactttcttttaactctttagcagaatggactaatgcgataaaactgacattttctttattattagttgctgccaaaaattttttcaaaatggtaaatggaccgccagtggtaaaattgaccgcagaaacaacgactatgctttttcccataatttggtctcatgattgtatttctttatgatttttgctggtactcccgcaatgacagtattttcgggaatagaacctctaacaacagaattggcgccgactacgactccattaccaataattgttccaggcaaaaccgtcacattctcacccaaccaaaccctctggccaattacaacagctgaagattccaacgtgcgcatgtctggaggtatatttggcgaactcattggatcagagtgcttaaaggaaccgtgattatgatcggtaataaatactttacttgcaataagcgtatcccgacctatcgtaacgctctcaattgaggcgatatgaacatagtcgttaacttgcacattatcggaaaaaaaaatcacgccacgtccaaatgcatccagcctgagaccgactccacttgtgaaattttcaccaaaattaatgctaccatcattgcgaatatagcagggaaatcgaataattctacagttccggtaaaatacacgagtcaataagacatctctaacaagccgaataaaaccacagagaccatatcgtttagcgagttttaagatcatcgatcacctcttcaagaacatccctgaagtaacttcctgttcgaattttctgagaaataatttttgtattctcactaatttgcttataagtttctattgtcatggagtcaacaatctcttgcatttctttgattgatcccactgcatatcctattctattatctacaatgaaatccgcaagggcggctttatcccatataaatactggaagttccattgaaagataaagagatgtcttatgagggttattaaactttaaatagtcgccaaaggcaccactacaggtttcgacagaatctccatcccaaatgagtccaaattgcatgcctgggaggttaatcttttccggagattgagcatcaaaacttccaagatatttaggattatctttattttcatagttgacaccaaagagagtaaaatcgcatccttcagtatatatgaaagaacatttatgcctagaaaggttgccagcatatatgacccctcgttgcttatccgtaacatctcgatgctccacatcagatgagacgaggtaatcaaatatttttatgtctttgattttatcctgagacatatatttactaaggtactttgtcatttgtggattgtgacttatgaccatatcacaggtagcaagccgcacagaatcactaccccctcctcctcttaattcatcaatatcatgaatcagaggtactattctaaattttagaaggcggtgaaagaatgacaatatatgccaaaatggtttggccatcgggaaattgaaaattaaaacatctttattttcaagaccgcagagaaatgtactaagcttaacagaactaataattctctggactactccaccccatagaggaatgttaacaacagaaatgttttcataatctgaagcaatgtccagtgcatcttttcttgctttaaatccagcatcgcgtctagagaaatttaaatcattcaaaaaatacattttcactttattttctgggccttaagaaattgagagaatactatgatacaaagagttatttgtatccaactgctaatattagtcatgaagctttcatgataaaaaatgaaagaaaaggtataaataaaatatgaataaaatattttcacagatatgtaatttcgagacaatctccataaaacacctgaaatacagccatgaataaccatcatcaaatagcttagctccgcggaaatataaacataatccgaaaaagcagtataaacatttgttggcaaacccacccacacaaattctttatgcaacgacatagagactccacctgttaatagccccatcagcctttcaaaaaaccaaaagacatgagaactggcagagttagatacttgctgaaaataaaactcctgaaacgcgattatagggctgaccaaatacatggatagataatatgccatccccccaggcagtccacgtaaaaagagcatatacaaggagaatagaacacctacagctgtaataagataaacataatgttttactctattaacacctacgatgaatgcataagagatgataaccataaagacaatttgcttaccagtattcagtataattgcaaagatgaatacaataaaaacaagtaaagtaaatgttttacttacctttgtattagtaaattttttagaccaaataaataaagcaaaagtagttagaatgattggctgcatgtatgctgagaaatttcttgatgtgtcttcaacatcagcatctcttatcaaattcatatagctaagtaagctagtcccgaactggtagttacttaacctcatgcatatatatatcatcgaaaaagaaataactaacaagcctacattatgcactttcttcgatggtatgctataaatagcattattgacttttctgatatttagatctaatacactttccgtcaataaacatgacagggtaaatgtcaaaacattgcaaagtagaaaaatcaacgtagcgtcatttaactgaaaagcatatatatctgacgttatttcatatcccaataagaccagtgcgaagatgatattaacgcatacggctggataaaatatatccttcttaagatataaacagataaatgctgtaatgagaaagacactaattacaagatagatcattaatccgtactcattatatttttcacttgataaagagcggcagatatcacttgatgcatatcataatatttatactcggccaaacgcccgccaaatataaccttgtcttctctgctagctaactctctatatttcttaaaaagctccatgtttttattatcattaactggatagtagggttcgtcgccaactttccactctaatggatattcttttgtaacaaccgtatgctttgtctcaacatagtcaaaatgtttatgctcaattattctggtatatggtacattagcatcagtgaaatttattactgcattcccttggaagtttggaaattcatggcgttccgtctcaaattttaaagagcgatattctaacgctccaaacctatagtcgaagtactgatcaatgggtccagtgtagatgattctatgggctttactcgctagagaatctttgtctttcaaaaaatcaatgcctaattttacgtccacaccttcaagcattttttcaataagcttagtgtagcctcccaccggaataccttgatagcgatcggaaaaataattgttatcaaacgtaaatctcactgggattcgcttaataataaatgcaggcaattcttttgcacttcttccccactgcttctccgtataaccctttatcaatgcttggtataagtcctccccaactaatgaaatcgcctgctcctccaaattttcaggtaccttgtcaccatacttttttttctgagcattaatgatattttgagcttcttgaggatctttaactccccacatttggtggaaagtattcatattaaaaggaaggttgaataatttgtctttataaatcgccagtggagaattagtaaaacgattaaattctactaaatcattaacgtaatcccatatatatttatcattggtatgaaaaatatgtgcaccatatttatgaatctggataccctcacagtcctctgtgtacgcatttccaccgatatgatttcttttctcaatcactaaaacttttttgtttagcttttttaactcattcgcacaaacggcaccaaacaaaccagaaccaacaatgatataatcgtacataaaatcctcagcaaaccagtaatttattatttcttacgaacatcagcatgagtgacgtaactaagcactctgttgcaagcaatgttattgctgcaccaatctctttaaaaagagttgttagcggaaaaatcaacaacaaactcaacaaacccgcagcgattaaaatcttactgaattctttcttataattatgggtcagcataacttgaatgccatagacattacttaatgaaataagaaaaggcagaggcgatataatcattagcacaatcactgcattatcatatcccggccctatacttatttttactagtatagatgcacccaagagcagaattaatgaaaaagcaccaccaatcaaactcaagcaggtcaatgattttttaattaaaatcacacccttcacacgattaagaacaagcgtacttgatattcttgggtatattgcttgggtgataggatttaatagcccttgaagcgcgtttcttatagtattggccgcattaaaattccctacggacgttggtccagatataaatcccaggataataactattcccgtagaatataaactaatagcagatgtggaaataaaaacatgaaaaccgtctgctaaagatcgacgcacattatgtaatgatagcgtaactttaccaatccaaccttcatgaacaacgatagctagtgcaataattccagcaaccagatttgcacttgactgaataaaaccggcaattgctatatctgactttgtgttcacaaaaataaatgttagagggataatagccaagcgggataaaatactacttaaagtcagccatttcattttttcttttccctgaaacagccagatagggtagattaaattcccgactaatgcaggaacaaacgaccatataattacggcatgcttgttatattcaggaacaagcaaggtcatcgacgttaagaaaatcaatgtaatgacgataagaactatttttgaaaatatcaccgcccaaaaaatagacgttactttatctttactatctgctgctttggcaatactctgagttgctgtgagattgaaaccatattcaacaaacattatcatatatagcatagtcgcttggcaaaaaccgaatataccgaaattttcaggaccaagtgttcttacaagatatggaaatgtaagcaatggtaaaagataattgctaccttgaacgacagccagatatataacgtttcttcttaaagataatttattcgtattcatgcaattaattttaatctgataagctcatctaacgtaaagagcctttcatcttttggcgaaaggattaaccctgatgtttggggccaatcaattgcaatgcgttcatcattccaacatattccacaatcgctttcaggatgataatagtttgtagttttatattgaaattcagcgatatcagacagaaccaaaaagccatgagcaaacccttttggtatccacaactgctgcttattatcagctgaaagcagaacaccaacccatttaccaaaggataccgaattgggtcgaatatcaacagcaacatcaaaaactgctccatgagtgcagcgtacaagtttatcttgtgcgtactcgccgcgttgaaagtgaaggcctctgagtacattttttgatgaacgtgagtgattgtcttgaacaaagctgaccggatagcctagaatatgttcaaatgctgattgattaaagctctcataaaagaaacctctatcatcaccaaatactcttggctccagaattagcacatcttcaatttcagttctaatcacattcattaatttgaatccttcgtcattttataaagatactgcccataattattctttattagtggtacagctaattttcttacttgctcaacatcaataaaacctttacgaaatgcaatctcttcaggacaggaaaccttcaatccctggcgctcttcaattgtcgcaataaaattacttgcttctatcagactctgatgagtccccgtgtccagccacgcgtagccacgccccatcatcgcgacagacagacgtccctgctcaagataaatacggttaatatctgtaatttctaactcaccacgtgcagacggcttcaagtttttcgccatctgaaccacgtcgttatcataaaagtacagacctgtaacggcgtaattactctttggttctaacggtttttcttccagactgattgccgtaccgtttttatcaaactcaacgacaccatagcgttctggatcattaacgtgataggcaaataccgttgcaccactttctttgttaacagcggcctccattagcttcggcagatcgtgaccgtaaaagatattatcaccaagaaccaaagcacaatcatcaccaccaataaactcttcaccgatgataaatgcctgcgcgaggccatctgggctaggttgcactttgtactgaagattcaggccccactggctaccgtcacccagcaattgttgaaaacgaggagtatcctgaggtgtactgataatcaaaatatcgcgaatacccgccaacatcagtgtagagagcgggtaatagatcatcggtttatcataaataggtaatagctgtttactgacagccatagtcacaggataaagacgtgtaccagaaccacccgctaaaataatacctttacgcattttcatttcatcattccttttaattcatcttgctccaccatcacgaacaagatgcaaaaactattaaattgctgtagtcgtaaataattcattgagcattcgtttcacgccaacctgccagtcaggcaagacaagcgcaaagttctgctgaaatttttctgtattaaggcgagagttatgtggacgacgagctggtgtaggataggctgttgttggtactgcgttgagcttgttgagtgcaaggggaatgcctgctttgcgcgcctcttcaaaaaccagcgcagcataatcgtaccaggttgtggtaccactggctaccaaatggtacaagcctgcgacatccggtttattcagtgcgacacgaatggcatgtgctgtacaatcagccagcagttcagcacctgttggcgcaccaaactgatcgttaataaccgctaattcttcacgctcttttgccagacgtaacatcgttttggcgaagttatttccttttcctgcatagacccagctggtccggaaaataagatgcttcgcgcaatattcctgtaacgctttttctccggctaacttggtttcaccgtaaacatttagtggtgcggttgcatccgtctccagccatggcatatcgccatttccagggaagacgtaatcagtcgagtaatggataacccaggctccaacttcatttgctgctttcgcaatcgcttcgacacttgttgcgttaattaattgtgcaaactccggttctgattctgctttgtctactgcggtgtgagcggctgcattgacaataatatccggccgaatgcttcttacggtttcagctacaccttcaggattactaaaatcaccgcaataatcagtagagtgaacatcaaaagcaatcaaattacccaaaggtgccagagcacgctgtagttcccaacctacctgccctgttttgccaaaaaggaggatattcattactggcggccctcatagttctgttcaatccacgattgataggcaccacttttcacattatcaacccattttgtattggacaggtaccattccaccgttttacgaatcccgctctcaaacgtttcctgtggtttccatcccaatgcgcgaccaatcttctcagcatcaatagcatagcggcgatcgtgtcccggacgatcagcaacataagtgatttgctcacgataagatttctctttcggtacaatctcatccagcaaatcacaaatagtgagcactacatcgatgtttttcttttcgttgtgcccaccaatgttataagtttcacccgctttaccttcggttacgacggtatataacgcacgcgcatgatcttcaacatacaaccagtcgcggatctgatctcctttgccataaataggtaatgccttaccttccagtgcattaagaataaccagtggaataagcttttccgggaaatgataaggaccatagttgttcgagcaattagtcacaattgtcggtaaaccatatgtacgtttccacgcgcggactaaatgatcgctggatgctttggatgcggaataagggctgcttggcgcgtaagctgtcgtctcagtaaataagggtaattcttctgtattatttacttcatctggatgaggcaaatcaccatagacttcgtcagtagaaatatgatgaaaacggaagctatttttcttgtcgctatcaagagcagaccagtaattgcgagcggcttccaaaaggacataagtaccaacaatattggtttcaataaatgccgcagggcctgtaattgaacggtcaacatggctttcagcagccaggtgcatcactgcatccggctgatgctgagcaaaaatccgtgccattgcaggtgcatcgcaaatatccgcatgttcaaaaacatagcgttcagaatcagaaacatcagcaagtgattcccggtttccggcgtacgttaatttatcgacattaacaacactatcctgcgtattatttataatgtgacgaactacagctgaaccaataaatcctgcgccaccagtaacaagtattttcacttaatttattccatattacttcagagcatgctgtgaaataagcggctctcagtttgattaatagaggtattaatgcacgctaccgcccctggctttacagctaccagagcactgcatgcatgcctatgatgtgacgagcgttacccactcgcgctaaacccgaaaaattcaaacgctaattgtcttaccaatccgctctggaaacaaggaaaatcctggaaaactttgaataaaaccctactgctaactcgttgttattctgatggtttatataaaacaacggcaggaagattcgcaacaaattacttttgctgcgaattttcactgccgttataattttcttatcaaccgttacatccggtcagattttcattattcgcttaacagcttctcaatacctttacggaacttcgccccttctttcaggttgcgtaggccatacttcacaaacgcctgcatatagcccatttttttgccgcagtcgtaactgtcgccggtcatcagcattgcatcaacggattgttttttcgccagctcggcaatagcatcagtcagctgaatacgtccccatgcaccaggctgagtacgttccagttccggccaaatatcggcagaaagcacatagcgacctacggccatgatgtctgagtccagcgtctgcggctgatccggtttttcgataaattcaacaatgcggctgactttaccctcacggtccagcggctctttagtctggatgacggagtattcagagaggtcacccggcatacgttttgccagcacctggctgcggcccgtttcgttgaaacgtgcaatcatggcagcaaggttgtaacgtagcgggtcggcgctggcatcgtcgatcacaacgtctggcagtaccacgacaaatgggttgtcaccaatggcaggtcgcgcacacaaaatggagtggcctaaacctaaaggttcgccctgacgcacgttcataatggtcacgcccggcggacagatggactgtacttccgccagcagttgacgcttcacgcgctgctcaaggagtgattctaactcataagaggtgtcgaagtggttttcgaccgcgttcttggacgcgtgagttaccaggaggatttctttgatccctgcagccacaatctcgtcaacaatgtactgaatcattggcttgtcgacgattggtagcatctctttgggtatcgccttagtggcaggcaacatatgcatcccgagacccgctacaggaataactgcttttaaattcgtcattatttcatccacctgtaaaatggttgctgaattatagcttgttcgatttttttcgccagcatcaattaccctgaattgattactgaattacttgtgatgttacgccgcttcgttgtggattgcagtagcattgttcctaagtatgactccatttttccaggaatggtcgcaaatctactccctcagttccggcaatctaaagttaatcttctccacattaacaatatggtgattaatcctgtcgatatcgacggagctttgtcctttttcattcaccgcatgaacatttgcaagagacagcagtgtttcttttttcgccataaaaacaccacgaacgtctttgcgcatgtcaaagttcatgctcaatgcgggtccaactgaggattcctgcatcacattgatatttcgcataaaaaaatgttgcggtttgttgtgtaactccagcgacgcacgcttcatctcaatgttagttagcgccacaaaggaaacagcattcccggcggagatttgaatgccgcgcaatttataagcaagatgagtattatccagttgaatatcattcacccggaaattttgcggtatcgagagatatttgcctttaattaccccatagccgattaacatcccggcgctattaatcatttcaatattatcaatcacgaaattgtcacaaccgtaaatagcgactgtcgcgttatcaatgcccgctttcttactgaaatccggcgtgatattgcgggctttgatattacgaataacaaaatgtttaccattttcaacatgtatcaactgccgacaatccgatcccgtgatattcgccacgacaaagtttttcactgcctggtcttccgggtagttgttatcataagtgcttcccgcaaggcctatgccgatgccccagttgattttgccgttggtacagttgatgcgctcgatgacatggtcagatatcaaaatatcacggtcgttaattgccacgttccattcaatggcgtcgccttgtaagtcgctgaacttacaattggtgatgttggcaccgataatctggttatgaaatccctggcgtaagatggcgtaattagcgtggctaacggtcaggttatcgatgatcaggttgcgcatgacccgtttgtttttgccgccgatataaatctgcgtcaccgggccaaagccgctcatagtcagccctttgatggtgcagtcagaaccacgcacatccagggtgatgttatgcatactgccgccatcctcccctgtcacctggctgccgtcctgtaagacaaatcgccctctgccgttgccgcgcaagcttccaagaatgtgtaacgttttaccgggagggataaagatgccggtgttgatattgtcacaaaccaatccggcaggcacgacgactgtttgcccttcgctgaaggcttgtttaaatgaggcgatccagtcgtgtgggttgtagtcgttaatgttaacgctttgtcgggcgggaagcgcgcgggcgaaaggggtatggaggaaggcaagcgccgagcttgccgtcaggaacgtgcgtcgggagagttttttaaatggcatgcgttctcctctataaagcctgcagcaagctggcgagttctcgattgatcacctgctggttaaaatcgtgttcaactttttcgcgcgcgcgtttgacgaccggagccaattcgtcggtgtccagttggctaaacgccgccagtcgttgcgccagtgcgcgagcatcgttctcaggcaccagccagccggatttgtcagcctccaccagttccggtattccactatgcagagtagaaaccaccggaataccgaccgccatcgcttccattagcgccaccggaataccttccatatcaccatccgcacctgtaaccgatggcaacaggaagacatccgcgtcgtcgagcatcgctttcacttcatggctcggtttaaagcccggcatctccaccacatcttccagttgatattgttcgatgagggtgcgcaggcgtctttcccacgggccaatgccgaggatgcgatagcgaaatgccacgccctgctctttcaactgacggcaggcttcgatcgccacatgcaggccttttttctcggttaagcgtgcgacggaaataatctccagcggcgttgcgggcgctttcacgggacgcgggctaaagcgcgtcatatctacgcccatgcgcgatacggcgattttttccctcgggcagcccattttttgcagccttccggcccacagatcgcttatcggtaacatcaggtcgccacggcgaaacagttgctgatattcgggagtgtagtggttgagcacttcccgactggagatatcaataccgtggaagatagtggcaattttgccgcgaatgacacccagttcgcggagttttgctgcggttacccccgcgggaccaaaatgagcgatgaacacatcggcgcgaaacggtgttgcgacctggccgcaaatggcagacaaaatcaggttccgcgactcggcaccatagcgtttgaggttgagcgcctgccaggtatttttacgatgaatgccgcgcaaggtctggctggctcggtggcgcagtttcgccactttgcccgtaggttcgtcctgtaaccagcgggttctggcagcaaggttgtatttcgtccatgccgcgtgggtgttttgtgtgtcgcctttttgcagcgcgagaatctctacctcaaatcccatatcaataaacgcggtaatttggttaaggacgaaggtttctgacgacagcgggaatttcagtaaaaagaagccgaccttcatttcacctccccgatgcgctcaagcacagactgcaccatctgcattcctgtctgacgctcacgactgacggcttcactaagtcgcgcattcagcgccggaagctggcctaaggtatccgcaaccatcgcttgcaggctgccgtctaataaatgacggatatcaattgccatctccggtagtcccagctgctgcataatcccggcggatttatgttcgtagttgatggcaattgccggagtggcaaaattcatcgagataatggcagagtgcaggcgcgtaccgacggtgagttcacaggcccccagaattttgcccatttccagatcgttgagttcatccatcactacgtggtaacgggcaggatcgctgatgtgctggcgcaggttgagcgccaccatgcggtcgtctttgttatagctgtcaatgcccgtacaggtggagagcgcaatcacctgatacccttcatcgagaatgcgattgaccaccccggcaaaggctttttcatacgcttgttgagtggtgccgagacgtttgtcaaacggtgccagttcgcgcagggtaatggccaccgttttctgttgtgcggcaacgtccagccagtgttgaacggcatagctggcggtgaagtcttctgtgtggtgatcgaccagccacgcggtatcgacgccatgttccacttttgcggtggtgatattgctgcgtttcatcagatcaaagctgaccgattcgcgcaggatcagcgcgtcgcagtgaccaaaaacgtagttcgccagttggttaaattgctcatcctggaacgggccaacactgtgaccaatcataaacagcggctttttcgccataaacgtgcaaagtgcatgttcaaactgcggcacgccatagagatcgacaaaaaacgatccgccgacctggataatggcgtcgtaacctgacagcaggcgcacgaagtcggtgaatccctgggcgatggcgatattgcgcagcttgccagtgtcggtgacgcgtgagagcaatacctgatgctggtagcggcgacggaggacttttttaacgcgcccgacaacgcccgccgcgctgttgtgttgtttcatttgcaggaacagcggatcgcccattaccgggcggttgagcagccaggaagaactgaccggatagcggctcatcacatccacttcggcgtgtggattgagaatgttgatggcatcaagtaagccgcgcaggatggcgctgtcgccacgattgccgcaagtgtggttgcccagaataagtaatttcattttttcctcataaatttgatgccaggtgaggctgcgtttgttttgttcgttgccgctttttgcctgatgcgacgctgacgcgtcttatcaggcctacaagacccgagcacagaaccgtaggacggataaggcgttcacgccgcatccggcattcagtgcctgatgcgacgctgacgcgtcttatcaggcctacaggtcccgagcacagaaccgtaggacggataaggcgttttacgccgcatccggcaaccgttgtcggaaccgaaaacagcaactcaccccgcccgtaaaagcattttcattttttcgctgcgacaaaactgacgcttcacttccaccaccagcggatggcgcgacagcacaatcatcaccacaaacgccagcacccccgtggctatttgcaccgccagcagcatccccagcgccagttgccctttcagcacaatgcccagcgcataactgaccaccagcgtcggcagcgagagataaaacggcagccataaactcaggatgtactggcgataactggaaccaagaaccggtttaatcatcacgaagtaactcagaatggtgttgataatttgcaccagcaggaagccaagcgtgacgccgatcgcgcccgccatctgcccacctataacaatcgccggaataaacagaaatgttttgaatacgttgaatttaaagctgatatcgacccgcgctttcgccatcagcagcgaaccaatcgggttacctacggagcgcagcagacccaccacacacagcaattgcagcaccggaataatgctgttccacttctcaccaaagaccagcggtacaaagttattcgacaccaccattagcccgagcagcgccggaaagttgataatccccactaccgacagcagcttgtagaagttaacacgcagcttttcggtatcgtcctgaattttggcgaatgccggaaacaacacgcgggtgatgattgggttcagcttcatcggtggcacaacggccacgttgtacgccaggttgtatccccctgccacgcccgcgccgagaatacgcgccagcacgagcgttgaaaggttggtattgagatagttgatgatgctgtccgccgtcagccaggcaccaaagcgtaagttcggtgccaccgacgccagcgagaaatgcagaccggggcgataaattttgcggccaaagtagccaaacagcagcgttctcaccgcactattgaccagataaccgaggatcgcggtcatcgccagcggccagaaatgggcgctaaccaccgtacaagtgaagcccgccagcaccgcgctggtttcgatcatgccgattttgttgaactccagctctttttgcatcaacgcgcggaactgttgcccgtgggggattaccacaaacgccagcgataatgttttaatcaacggtgccaggtccgggttattcagcacgtcgccgatgagatcactcaacaaaaacaccgccacgcacaccacgatccccagcccgacgttcagccagtacaacgtggtgagttcaaggtgactgatttcttttcgctgaataatcgagttagcgataccgaagtcagaaagcgtatctgccagcgcgataatcaccagcgacacggtaagcaggccgaactggtggttgtcgataatccgcgccagcacggtcatctgcaccagcccgaggccgatgatgatcaccgtggcaatcgccgaccacttcgcgccgctgatggttttttcacgtaagctcatatcaatatgccgctttgttaacgaaacctttgaacaccgtcaggaaaacgattttgatatcgaaccagacgctccattcgcggatgtactcaaggtcgaactcgacgcgtttttccattttctccagcgtgtcggtttcgccgcgccagccgttaatctgcgcccagccggtaatgcccggtttcaccttatggcgcagcatgtagccttcaatgagctgtcgatactgttcgttatgcgctactgcgtgcggacgtggaccgacaatcgacatccccccggtcagcacattgataaactgcggcaattcatccagcgaggtacggcgcagaaagttccccactttggtgacgcgcggatcgttctgcgtcgcctgggtcaccactttgtcgttctccatcactttcatggaacggaacttccacactttgatcggcttgccatccatgccgtagcgagtctggcggaaaataaccggccctggtgaactgagtttcaccgccagcgcaatacagcacagcaccggggagatcagcagcagaataagcgtcgccagcacaatgtcttccgcacgtttgagcaggcggttaaccccggaaagcggcgtgtcgtaaagcggcaccaccggtacgccgttcatctcttcgaggcgtgaatggagaatgttgaaggtaaagacgtcggggatcagcagcaccgaacaggtggtgtccgccagttgatggaccagttttttcactcgcgcgccgtcgcacatttgcatcgcgatatagacgttatgaatcttgcccgctttcgcgtcctcgaccagctgttgcaggttacccgcccagtcgttagaaacgccgcccggtttcgggtcgtggtaaacgcccaccacttcaaaccctaaccacggctggttacggaagctctccatcagcatttgcccggcggctaaatcccccgccaccgcgaccatgcgcttgttatagccatgattacgcagccagcccgccccaatgcgaatacacgaacggcaaaccaccagtccgatgctggtcagcgcataccacgccagccagattttcagttgcgtgtcgaaatcattgttgaacgccaccagtccggcgctgaaaatcacgcttaaggtccagttttgtagcaacagggcaaattctgtcgctgcccgaacaccgcgccatgagcgataaaaatcggtgatgccgcccagcatctggaacaccaccagcgtaatcagcgccaccaacaggtgcatgtagaggaatgacagtccgctgacttcgcaaaccagccatagtccggcaaacatgatggtgatatctgaaaagcgttgcaccatagagattaacgatgcattggttttcgctcgctcgcgcttttttagatttgtcatcgttgttcctgttattagccccttacccgcagtggggtaagggaagatccgacattactcgttcagcaacgtcagcagagttcgcgttcgcgcttccatcagcggcacatcaccgcgcgattccacattcaggcgcaccaccggttcggtattggaggtgcgcaggttaaagcgccagtcggcaaaggtcatgctgatgccatcggtgcgatccaccgccagcgcctcacggctaaaatgctgttccacgcggttaatcgcctcaacgggttgcgccagtttgctgttgatctcaccgcttgccggaaacgccgccatccggtcgcgtaccagttcgcccagcgttttatctttcaggcacaccagttcggcgaccagcagccacgggatcatgccgctgtcgcagtaagcgaaatcacggaagtaatggtgggcgctcatttcgccaccatagatggcgtcttccttgcgcatacgttctttaataaaggcgtgtccggttttcgacattaccggcgtgccacctgcggcagtcaccacatcaacggtgttccaggagagacgtggatcgtggatgatcttcgcgccgggatttttttcgaggaatgcttctgccaacaggccgacaatgtagtagccctcaataaactgccctttttcgtcaaacaggaaacagcggtcaaaatcgccatcaaaagcaatgcccatatccgcgccgtgtttgatgaccgcattgcgggtgtcgtcgcggcattccggcagtagtgggttaggaataccgttggggaaattgccgtccggcgtgttgtgcactttgattaattccacgggcgcgccgagggctttaaagcgggcttcaatggcgtccaccaccggacccgctgcgccgttcccggagttgatcaccagcttgagcggcgtgaggtttttgacattgatataaccgaacaggtgatcaacgtaagcgtcacgcaggttgatttgctgatagcgaccgcgtttggtttcatcgacgggaggaaagtcgttggcttcagccagacgctggacgtcgcgcagtccggtatctccgctgatcgggcgagccccctcgcgaaccagcttcatgccgttataatccatcggattatggctggcggtaacttcaatgccgccatccacgccgagatggaacgtggcgaaatagatctcttcggtgccggacataccaatatccagcacgtcaacgcccgcatcctgtaaacctttcgccagcgccagttttaaggtttcgctggtgaggcggacatcaccgcctaacacaatggttttcggtttgagaaattcgccataggcgcgaccaatgcgccaggcgatatcttcattcagttcttcgcctaatttcccgcgaatatcataggctttaaagcaggttaattttttcatatcgttaccctttttcaggcaatagttggccctgaccgaagcggccaattttatttttgtcgttatttacaccgcggtttcgcattcattgcctgatgcgacgtttacacccgtccgtagcgatccgcgaaacgcaccacatcatcctcttcgagataagagccggagcgcacttcaattaaatcgagcggaattttccccgggttttccaggcaatgcgtcgcccccagcggaatataaatggactcgttttcaccaagcagtttgatatcaccatcaatggtgacttttgccgttcccgcgacaaccacccagtgttccgcgcggtgatggtgcatctgtaccgacaagccctcgcccggtttcacggtgatgcgtttcacctggtagcggtcgcccgcgtcgatagagtcatatttgccccacggacgatacacttcgcgatgcacccgatgctcatggcgaccatcggctttgatctgctcgaccacttttttcacatcctgtaccgcgttacggtcggcaatcagcaccgcatctttggtctgcaccactaccagatctttcaccccgacggtggtgaccaggccagattcagcatacacatagctgttttcagttttgtgattaatcacatcgccgtggcaaacgttgccctcggcggtgtgggcgctgatctcccataatgaagaccaggagccaacatcgctccagcccgcatccatcggcaccacaacagcatctgccgtacgttccatgaccgcgtaatccaccgactcttccgggcaggcgagaaacgcttcttcatccacgcgaataaaattgagatccggatcgacggcgctcatcgctttttcacaggcatcgaggatatccgggcgatattttttcagttcttcgagatagcgtccggcgcggaacaggaacataccgctgttccagtaatattcgccgcttgccacataggcctgagcggtttccagattcggtttttcgacaaactgcgccacttcaaaggccaccatatcctgctcacccgcagacacttcaccgcgacgaatatagccataaccggtttctggtagatccggcacaatgccgaaggtcaccagcttgcccgcttcggcatatggcatggcattacgcacggcggcacggaacgcgtcttcatcggcaatcacatgatccgccgccaataccagcattaacgggtcgctctccgggctatgacgttttgccgccagcgccgccagcgcaatggcaggtgccgtgtttcgccctgccggttcgagaataatgttctcggtaagtttgttcagttgacgcagctgttccgcgacaataaagcggtgctgctcattgcaaatcaccaccgggctttcgcactccacgccgttcaggcggcagatggtggtttgcagcatggtgagatcgcctttcaggcataaaaactgcttgggataaagtacgcgggaaagcggccataagcggctaccggagccacctgccatcacaactggatagagtttcgactgcgccataattatccccgaatatcatttataaattgacgtaacacgttctctttatcgagcgtgcgttcggcatattcacgtgccaccgtgttgtgtttgggcagcaggagcgcctgacggatccccgccaccagcgcctcgaccgattccggttcaacgcaaaccgcaatgcccggaaaggtttcgcaaagctgccccagttctgtgtaggcttcagcagtaatcaccgcgttaccgcctactgccagaatattggtcagtttcgacggcaatacggcatctgccgcgccgcgtttttgcaccaccagatggcaatcgcccatcttcagcagtgcgggtaaagcgtcatacgattgcagcgggaaaaattgcatgttgcgcagtccacgctgctgcgccattttttccagccgcgctttgccgccgccctgcccgacaatggcaaaaatcagcggttcatcgcgcagacgatcggcagcttcaataacgttttccagcccctgcttttcaccaatattgccggagtaaagaatgatttttttgttatccggcaggtcaagctggttacgaagggcatcaacatcggcatctgcaacatgctgaaaacgggcaatttccgaccagttggggaagaagatgacgttttccgccgccacgcctttttcgatggctttattcatcatcgaacgcgaaatcgtggagacgttatcgacgttatgcagtccgctacgttcgaacgccgttgccagctgtgccactttgccgcctttgccttttccggcaaggcccagccccagcatggcgtccacttcgtaatcctgaatatgcagcacggtacgcgcaccagagagtttcgccagcaggcgcattcccggcgcgcaaaacagcgttggcaccacgccaataatgcgatccggcttccagcgacgttgcgccatcagcggaaagaaactgctgacggcaaaactgcccagatgcaacaggcgtttcagggtgctcggctgttttggcacatacagcgggcagcgccacaccgtggcggccccctcttctcgtttgtagcgccaggcggaatagttctcgcccacctgccattgcgggtagtaaggcggtgcggtaatgacccgcacctcatgaccttgtgccgccagccattccaccatctcgccggtgtatttgccgatgccggttaactccggcgagtagttaatgccgtagaccagtattttcataatccgggtactccggtacgcttctcagcgagaaaataggcgcggctgttagcatgaacattatcactggcgagcagcgcgtccgacgtcagccagcggtaatcgtcatgctgctcatccggcagtaacagctcttcttccgatactctgaagcgaaaaccgagcaccacatagtgagtggtgaaatccgtgccagagaagttatcgtcataaaagtgctgccagacaccgtaaaactggcctgctgttatcggcaaacgcagccccagttccgccatcgtcagccgctcaaatgcggcttccagcgtttcgtctttctgcacgcgccctcccggcacaaaccagtaaccctgcgccgggcggttggttcttttgccaagcagaaactcgccgcgactgttctcgacaataaagtcgagagagacaagcggagtggagcgcactaccgtggcaaagtcttcctgacgtaaaaacatcattacccccgaaagcggtcttgattctcaaggaaccactggtaagtgctggcaagccccgcttccagtgagatttcgtgataccagccaagctgatgcaggcgcgtcacatccagcagtttgcgcggcgtgccatccggtttgctggcatcaaaaaccacccggcctttgtaacccaccactttggcgatggtttgcgccagctcgcggatagtgcagtcaacgcccgtgccgacgttaatgtgcgacaacatcggctgggtgttctccagccagacttcatgcgccagctccatgacatgaatgctcgccgccgccatatcatcgacgtgcagaaattcgcgcatcggtgtaccgctgccccataccaccacgtccggcgcattctgtgccgtcgcctcgtggaagcgacgcagcaatgctgggatcacatgcgaattactcgggtggaagttgtcgtgtggcccgtacaggttggtcggcatgactgagcggtaatcgcgtccgtactggcggttgtatgattcgcacagtttgatcccggcgattttggcaatagcataaggctcgttagtcggctccagcgtgccctgcaacaactcgctttctgccatcggctgttttgccagtttcgggtagatgcaggacgatccgagaaacagcagtttgttcacgtcgttctgatgcgcggcgtgaatgatgttgctctcaatcatcatgttctggtagatgaaatccgccggataggtgttgttggcaacaatgccgcccactttcgccgccgccagatagacctggtcaatacgttcgctggcaaagaaatcatgcacggcgcggctgtccagcaggttcagctcgtcgcgggtgcgtaataccagttccacatcaccgcgctgttcgagctgccgcctgatggcggaaccgaccatcccgcgatgaccagcaataaaaactcgttgtttactcatgcttatgactccagcgcgatcgccacgtcgtagccgtgagatttcagcagagagtgttttttcgccgcttcgaggtcattagccaccatttcagacaccatctctctgagggtgatttccggtttccagcccagtttttcgtgcgctttggtcgggtcgccgagcagcgtttcaacttcagccggacggaagtaacgcgggtcaacagcgataatcacatcacccggtttaacgcccggcgcgtcatgcccggtgacggaaaccacaatgcccttctcttcaacgcccgtgccttcaaagcgcagtttgatgcccagctgtgctgccgccatttccacgaactgacgcacggagtactgaacgccggtcgcgataacgaaatcttccggctgttcctgctgcagcatcatccactgcatttttacgtagtctttggcgtggccccagtcacgcagggaatccatattgccgaggtacaggcacgactccagcccctgggcgatgttggcgattgcgcgggtgattttgcgggtaacgaaggtttcgccgcggcgcggggattcatggttgaagagaattccgttacaggcgtacatgccgtaggattcacggtagttaacggtgatccagtaggcgtacagtttggcgaccgcatacggagatcgcgggtagaacggcgtggtctctttctgcggaatttcctgcaccagaccatacagttcagaggtggaagcctgatagaaacgagttttcttttccagaccgaggaagcggatcgcctccagcaggcgcagcgtacccatcgcgtcgacgtcagcggtatattctggtgactcaaaagagaccgcaacgtggctcattgcgcccaggttgtacacttcatccggctgtacttcacgcaaaatgcgcgtcaggttagaggtatcactcaggtcgccataatgcagatggaatttcgggttgcaggtgtgcggatcctgataaatgtgatccacgcgctcggtgttgaatgacgatgcgcgacgcttaataccatgcacctcgtaacctttttccagcagaaactctgccaggtaagaaccgtcttgtccggttacaccggtgatgagagcgacttttgacatgtattattcctctgtatttttgaatttattcagtttcaacgcgttcgcgtatcaccactgcgggattcccccggcaaaccacatttgccggaagcgatttaaaaacactgcttcgtgcacccacgacggtgccgtcgccgattgtgacgcctggggcaacaaagacatcggttgccagccagcatttctcgccaatcacaataggcgtggcgttaatggtgaaatgttgacttgcatggtcgtggctaccggtgcataaataacttttttgcgatatcaccgaatgtgcgccaatggttatttcaccgagggtatataaattgacgtcatcgccgacccacgcgtaatcacctaaggttaatttccacggataggtaatttttactgacggacgaataactacgttttttcctatttttgctccgaataaacgtaataaaaaagcccgccagcgatacaatacttgtggcgaccaggcaaatattgttgcctgtactgcccaccataattgcactttaatagcgttgccgccccggaaccctttcggcaccgagaaaccgcttaaatcttgcattggttttccttatattcagactttgttatataaggctttcgtctttgaggtagtacgttggcgtaaatgccaggataattcagcccaaaagccaggcacatgtaatatttgtcgttggacttttttcgcgtcagcacacaattccatattattggtggtagataccccacccatggaaaattcagacaccaggccattgagttttttaaatgcataaccggctttatacattttggctgccagcgcgtagtcggaagaaactttatattccaggtcataacgccattttttcaagccggatacagggaaaaatatcgcctgatgactggcgggcaggctgtgataaatataccagcccggtttggcgctacgtttaattttatgcccgtcgccaaaatccagcagcgcatcgccggtgatcatcacgttatctttttgcatttttaacttacggacaaaatttgcggcattctgatgaaaaatatcgcccgaattgagaaacaacgcgaacttgccttgtgccatcgcaatgcctttgttcatggcgtcgtagataccgttatctggctcgctgacaaagcgtaggttaaagataccattgagattttccagatactcacgggtgccgtcgttggaaccgccatcgacaacaatccattcgaagctgatatcttccacctgcgccagatgcgccagcgaggcatgtgttttgactatcccttcgaggttacgaaacgcgacagtgattatgctaagcaacatgttcttattcttacctcgtaatatttaacgcttttcgcaaaataaacggacagacgattaaaaatgcatattccgggctaaatatcgaaccggtaaaaaacagcgataccggagtaaaaagatataattgcacgcgaaaattgcggttatcaccaaaagcgttgatcatcatttttatcactttccccatgtaccacagtgataaaaacaccgcgaaccaggaaaaataaataatcagcagatacaaaccattgtctatggtttttccgacatccgcaccgttaaatattccgaatgatgcgacatattcataaagtgagccaaatctgactacaccgtcaatatgggtcaaagaataaccgaccatcaccagcggaccgacaatacgataatatgatgacgatccttccgtacctaaatcgcccagacgggtggaaatataaggaaacgcgattaccacaccaaccaggaatacagccagagaaatcaatgctaacggtaactttttcttaatcgcctctttattcagatattgaaatgcccactccagcaaataaaacaggataaaggtcataacccctgaaaacgatccggataatattatccctgcgagaatcatagcatctgttttaggcgttttgataccaaactgtttgatgctgagccaaattgagattaatgccagagcgaaaaatgccggttcgaaataaagtgctgtcgtgcgcttgccgccgaatttaatgaaattcagcacatagctgttgctgtaaatcagatatttcgaaatcgactccataatactgctgccaccggtgaggataatttgtgccatctccaccgccgccagcgccaccaccagcccgaccaccagataaaagaaacgtaatatcttgcgatggttgtgtggcgaaattgttttaaaacgaatactccacaccatgccaataatgatcacaatatagacaaacagcatagttgaagtgacgtatttactggcatccagcgactgaccaaacagatagttaaacgccgtgagtcccgcgccaatccctaaggcaatcatcaattttttaacgctgatgcgttctaaaaacagcagtaacaagacaggtaaaaaagtgacgatggtgatggggaaactttcgccaagctgggcgattttgacgttaaccagcagataaatcagcggcagcaacaggtagctacagattctgatagaagttgacatactcctccagcatctgttgtccactgtaggcggcgcggctgcgttggctgaactcagccagcgtggtaccaaatatcgcctgcgcgatttccggtttgcttaactgcaccagttgcagcacctcttcttcgctgacggttttaccgccggatttttgcaacacttcccgcgccgcatcgctatgggtggcaatcaccggcacgccaatcgatagcgcctcacacaaaatcagcgggtagttatcgacgcgagaactgaataccagcgcatccatctgattgagcgcgctcatcagcttacgtttgtcggtttcaaagccgtgattaaccacgttgccagcggtgaacggcgagaacttaccaaaggtatgcagttcaattttgtcgcccagcgccatcatctcgcgtaccagttgctggttagttttgccgtcgtaacgcagatcatgcgccaccaccgcgattttcggcttgccctgggtttcgcgcaccggaggcaagtccgccagaatcgcttcagttgccatatcaatgccattattgataatccggcaacgccctggaccgtacaggctattgaaagcgtcagccacatgctggctgggggaaataaactgacagcccagcgccagcatctcacggaataactggcgtttgcccgccaccagttggtgtgcgcgatcaatcttcaccggcggatagttatttaaggtcgggcatttctggcagcctgttttccagccttcgcaaccgtcggtaaaggcgcagcgtccggtaacactccagtggtcgtgcagcgtccagaccagagtgacgtccggtttatggtttttcactttttcgcaaaagcgcaccacgctcttaagatttagccagtagctgtgcagcacatgaaaatgcaggaccaccggacccgctgtgcgagtaatggtgcgatataactcattgaaattgccaaacagatcgcgattaaacagacgaaacagagcaatattcgccatcgcggtcatccgcggcgtatgtttgatgacctgcggatagttctgatggctgacgctctctttgccgcctttgccgtaaccgtagacaaaatgtgacgccagcccctgttgcagcgcacgctggtggagatctaacgccacacctgctgccccgccttccgccagtcgcacattaaattgcaaaatattcatttaattaccttcactcgcgctttttctcccaccaccagcgcgttgtccgggacagagtcgagcaccacgctgcccgcgcccacggtgacgttgttaccaagcgtgatatcaccaagaataatgacgttggcaccgagttcgacgccgttgccaatgtgtggacatgccatgttatcggcaccacgattgccgatagtgacgccgtggcgaatggtaaaatcatcccccgctaccacgtttttattgatcacgacggcgtaaccgtgatggatagtaaagcggcggccaatggtcgcggcagcctggatttcataaccgaaaaagcattcggtgataatgcgatacagcaccagcagcggggccgcccacagattgttgaggacgttctttttgcgccacaccgaacaaaaatgagcaacacgataggcaagaaccatgcagcacgggcgtaaactccagctgttggcgcgcagatcttccagcatctttagcgcccccgaataccatcagccagacgtttgccgttacgcaccgacagcagcgtcagcaaagtgcgccaggtcatacgtttattgcggatctggtagagggtaaacagctgatattttttgctggcgcggtcgaatttgtctttgtgcttgcggtaaaagtggaagtacccggagaattttttcggtgacgaggtgatctgcatttcaccgtgattgatatgcaggatctgcgtcgcctcttctactttccacggttcgccgtactccaccaccatccgcaggaagatgtcgtaatcctgtgccgctttcagttcggtatcgaacaaacactctttgaaacgccatgcccaggtaaagacctggttgccaatgatattgcgtttgtagaacaggcggcgtgaatacggcgatttgggatacagcggcaagcttgccggttgggaatagacttcgccctggcaaacgtagtcgttagcgtacaaaaaggcgtgtgtgaccagttgctgtttatgggcgaggaagacgctcagacggttgggtgtccattcgtcatcgtcatcaatcccggtgatatattccccttgcgccagcataatcgcctggttacgtaccgcgcacgccccgctgttaatgtcgttgtgaatgtaagtgatacgcggatcgttgagggcggtgacgtactgttgcagttgttcccaggaggtggagcaatcatccacgatgatcatctcccagttgctgtagtcctggcgcaaaaccgattttattgcccgaatcgccagttgttggcggttccaggtcggcatatagattgagatcagcggattgtttttcataggttgttctcccggcttatgagctggtttgcttgccggatgcggcgtgaacgccttatccggcctacggggcggtgcgaatgcaggcgtcgttatttcgcatccgacttatattcgtattcgtaatagccataatcctgatacgcgctggcgcggcggaagatggagttcagaatcacccctttcaccggaataccgttttgctcaaagcggctcagactggtttccacttctttcaatgtgttgaccgcataacgcgccaccattaacgtggttccgacatgacgaccaacaattgccgcatcggtcactgccagaatcggcggcgtatcaatcaacaccaggtcatagtttttactcgcccagttcaccagttcggcaaagcgttcgctcatcaacagttcagaaggatttggcggcacctgaccgcgcgggatcaggtcaaatttggcaatagaggtcggtttagcagcggtagtaatatcgccctgaccaatcagaatttccgacaggccattaacgttattagtgcccaacagctcgtgggtgtagcctttgcgcatatcgcagtcgatcaacaacacgcgtttattggtctggctgatcaccgccgccaggttggcgcagacaaaggttttaccaattgacgggctaaccccggtcatcatcaacacattgttctgtgcctgcatcatcgcgaagtgcaaactggtacgcagactacggatggcttcaatcgccagatcggttggattccccaccgccagtagctggctctgtttatagcgtttaatccctttgatggttttgacgctatcacgcgctttctgccattccgacagcgggatgctggcatagacgctaataccgtgttcttccagtacttgcgggctttcaatgccgcgattaaacaacgagcgcagcagcacacccacgatagaaagcatcaggccaaggataatcgcgccgaggataatcagccctttcttcggtttcagcacgccaggctgagtgattgccgggtcaacaatgcgcacatcgccgacggtgctggcctcggtgattttcagctcctgctctttattcagcagttgcatatagacctgctgaccagactcgacatcgcgggtcagacggacaatctcctgctgggttttcggcatcgccgttacgcgaccgttaagtttggctttttcgtcttccagcgcctgacgtttctccagcagcgtgcggtacgccgggtgaactttggtgtacagcttggagatttccgcctctttaaaggtcagttcgttcaactgcgcatcgatgttcaccatcgaatcgagcaccgcttttgcttccagcggcagatcaacagaatctttatcctgacggaaggcattcagtttgttttcggcaacatccaagcggctacgtacttccggtaactgttgcgcgaggaaggcgaggcttttcgacgcttccgccgatttgcgctcaatattttgttcctgatagttacgggcgatgctgttaagaatgtcgcggatctgttcacgatcttcaccggtataagtcaggctcaaaacgccagcgtctttgccgttctccgttaccgtcaggctgttttgcagttggttgatcatccccagcgtggagtatttggtgacggtaaactcactgcccgggctggcgtgaatggcttcaaccatcagcgtgacgccttcttttttcagcatctggcccgcttgcccccgggcgctaaagccgccgtcgctgctcagggtgtagtttttgttgtccagcacattaagcgtaaacacctgatccgccatctctttcgggcggttaaaggtggtcactttcaccgtctcgttctgacgtcccatcaggcgatcccagcccgcaccgaaaatcgggaacgtgtttttgctcactgcaatatcgaggtcgagatcgtccaccgttttaccaagcaccagacgcgaacgaatcaactggatctcggcgtccgatgcaggcggtttgttggctaatgccgaaccaatgtcctgcactaacgaattgccgctgttttgctcgatttgtaccagtgcgtcggcactataaatcggcgtggcgaagaaggtgtaaaccacggcacagagggcgaatacggtggtgatgccaatcacccaccagcgcgcttcaatgacggtgccgaccaggcgaccaatatcgatttcatcactgcccgttaccggagcggcatgttgttttactttttctgtcattcttatacctgctctgcgttcaatgcctgcgcccactggcgggcagaccgttcaagtaatgtgtacaccgctgcaaacgtttcccggcttttgcgatacggatcggggatttcacattcgttatcccagtgaccaaacagcatcactttgccgcgcatctccggtgccatctcgcataagcgttcgatatggcgcttttccatggtcaaaatcaggtcgtagttgcgacacagacggcggctgatttgacgggcacagtgaccttccagagacagttgatgttctgcggcgacgctgatagcggtaggatcagcgcccttaccgaccagcgcgccgagtccagcggactccactttcagctccgggtgataacgttgcagtaagcgttccgccgtcggggaacggcaaatattgccgacacagacaactaagatgttgttaaacatgacgattaccagttatgaatgtcgctggctgtatccgtcatgtaacggacaccgctaatagttggcagcaactgattgatcagacggttccagcgggaaaccggggcggtggtgacatacaccacgtcataaggttgcaggcggaattctgtcgccatcaccagcgacgtggcatcggacatatccagctggtagatattggcaatcttgccgttacgcccgccctcgcctttcagcggacgaatgacaaagatgccgctggcgttggaggtggtcatgtcgatgccttcagcattgcccagggcttcagtcagggtcatgccgctaaagtccattttcagggtgctctgtttcttcacttcacccatcacaaatactttcagatcatcattacgtggcacgtagagaatatcgccggggtaaagcaggcgattctggttgaggtcgccgttttgcatcagcgcctgcaaagaaatgcgctcttcacgaccattgtgtgttagcaccacgttgcgccagtcagcggtgtcggtcaggccacctgcggcgttgatggcgtcgagaatagtcagtggcacgttggtgatcgcctgttgaccggatttattcacctgaccggagatataggccttttgtgagcggaaggcggcgatattaacgtccacctgcgggtcagcgatgtacgtcgctaagcgcccggtaatatcactgcggatttcagcgagcgttttcccgactacgtggaccttgccgatatacgggtaaaacatagtgccgtcaggctgtacccagttgccggtgtcgctggagctgcggtactgaccggctggcgtggtgagttccgggtgatcccagacggtgacattaagaacgtcccccggcccgacgcgatactggtaattcgcgatctcactttccagcgtcatattggggcgcgctacattcgggcgtgggcgtaattggtcaatcaggcgcggggtcagcggataaacattcaccattttgtcgagatcgaaatcagcgtcctgctgtttgatgacgtctttgcccatcgtcgacatattgctgcccggaagtactgtgcaaccgcttatcaaggttactgacaccaataatggcatcaatttcattttggatttcatcattgtttatttatcactttggcagagtaattatcctgtgcactattaatagcaatgtcgccatgcacatttaccttgcagttaattgaataaaaatttaactggcatcagtcctaaaaaaattgatttcatccgcaggctattgacagaataattcagactggtctttcaggcatccagacacgctaccgcccctggctttttagctaccaatacactgatttagtttaatttttcacaccctctcagcatgcagtcgttgatgagaaagggttattacggaaattaacttccgaatataaggtgacattatggtaattgaatattggctttccaataatgcaggaggaagtgttacagctaacggaatagcaggcaagataacaattcggtaattggctatttttaagaattatattaagtgtcattcaatatggtttttaggagtttctttaggttgacaatatttaatatagtgtctccacatgcgatatttcttaaataatgttttattattaccacttttaattcagggataatgtgaggttattaccctcaaataatatgagataaatagtgctgcaacattgcatttttgccccgatttatccatgatcgaattgtgacatttgtcatacaacgaataggttttgtacttactatggaatggattgccgatccgtctatctgggccgggttaatcacgctgattgtgatcgaactggtcctcggcattgataacctggtctttattgccatcctcgccgaaaaactaccgccgaagcagcgtgaccgcgcacgggttaccgggctgctgctggcaatgttaatgcgcctgttactgctggcgtcaatctcctggctggtcaccctgactcaaccgctgttcagcttccgctcgtttacctttagcgcccgcgacttaatcatgctgtttggtggtttcttcctgttgttcaaagccacgatggagctgaacgaacggctggaagggaaagacagcaataatcccacacaacgcaaaggtgcgaagttctggggcgtggtgacgcaaattgtggtactggacgccattttctcactcgactcagtgattaccgccgtcgggatggtcgaccatttactggtcatgatggccgccgtggttatcgctatcagcctgatgttgatggccagcaagccgttaacgcaatttgttaacagtcacccgacgatcgttattctctgcttaagcttcctgttgatgattggctttagcctggtggcagaaggtttcggcttcgtcattccgaaaggctacctgtacgctgccattggtttctcggtgatgatcgaggcgctcaatcagttggctatctttaaccggcgacgttttctttccgctaaccagacgctgcgccagcggactaccgaagcggtaatgcgcctgcttagcgggcaaaaagaagatgcggaactggacgccgaaaccgcgtccatgctggtggatcatggtaaccagcagatctttaatccgcaggaacggcggatgattgagcgggtacttaatcttaaccagcgtaccgtcagcagcattatgacgtcgcgccacgatattgagcatatcgatctcaacgcgccggaagaagaaatccgccagttgctggagcgaaatcagcatacgcggctggtggttaccgacggtgatgacgcagaagatttgctcggtgttgttcacgttatcgacctgctacaacagtctctgcgcggcgaaccgctcaacctgcgggtgttgattcgccagccgctggtgttcccggaaaccttgccgttgttacctgccctggagcagttccgtaatgcccgcacgcactttgcttttgtggtggatgagtttggctcggtggaagggattgtgacattaagtgacgtcactgaaaccattgccggtaacttaccgaacgaagtggaagagatcgacgcccgccatgatattcagaagaatgcggacggttcctggacggcgaatggtcatatgccgctggaggatctggtgcaatatgtgccgctgccgctggatgaaaaacgtgaatatcacaccattgccgggctgttgatggagtatttgcagcgtattccaaaacctggcgaagaagttcaggtgggggattatttgcttaaaacgttgcaggtagaaagccatcgcgtgcagaaggtgcagattataccgctgcgtaaggatggcgagatggagtacgaggtgtgatggtatcggtcattttacccaatagccgaaaggaataagatgagggaaccgcgccatcggcgatttaccgccgggagcccgggttgccagggtggtggagattgagccaccctggcacgttcaccggcttgagcgttccatagtagcgaggaacatcaagtgaacggaacagccttcgatcttacatattcagaatataatgatgccgccacgaacgcctgatgcgacgctttacgcgtcttatcaggcctacaggactggtcacctggtaacctacatcttctccagcaacttcttcacatctttgccattacgggaatctttattccgctcggcccagtcattcaggcgacgtttcgcttcgtcctgtagatgtttgcgcagtaactgatccacttgcaggctgtaattgagttgctgccagttgccataaacccgcagcggtactggcgtttctttcaggaaatcaatcagtttgctttccccgttccagccacccacgacccgaatatcaaactgggtgtcgcaggtttgatctgccagattcaacatgccttcccctgtcagcgccagcacaggcgattgaccttgcatgtcgtttaacgtcacgacgccatccttcaacgtcaaatcggtggtaaagcggtcaagccgcgtcacgttatcaaagttttcagcggccttcacatcaccgccattacgctctaccgcttgctgaatcatctgctggaagttcatcccttccatgcgcgtgtcggtcatttcgacatgtgcctgtccttgccagttgtggcggaatgcgtcggcatctatgtcagcaccggagaaatcaccagccagtgacatttttccggtcaacgaaatcggatagttaaacgccttcagaatggtaccaatctcaacgttttccagccgtggctggaagtttatccgcggatttattgatgtcgcgtccagcgtgcccggcagtgaaacctgtccaccgttaagtttgccctgcagttgagtaatttccagcaaacccgacttgttggtcatttgcgtggcaacatctgtaaaattcattccgcgccagcgcacgttactggcctgcaacaaaatatcagccgtaaagccttgcagtccctgataggccggttcatcaatacgcgaagaaatgaccgggcgcggcaacgttgattggctctgcccctgctgcgcggcaccgttttcaccattcgcggtttcattaagcgggatgaggttgtcaagattcagttgcgggaattgcagcctcagctgccattccggtttctctgtcagcgtaacctgtgcttgcccgcttagcgtactatcattggcggtcaaactaatttggttaaatgaaaggcgtttatgtgactcctgccactgggcctggaaactcccctgcccctgaataccttgttttggtaaatcggcaccctgcaactgccagttaatttgttcaatagccgccgttaaatcatgcggataatcagaagcatctaccgtaccgttaagggatatcgtgagatcgcgctgatcgcgattaacccgcccggagaactcaaatgaaccacgatgttggggatcttgttccatttgcaggcgaatattgcggattgtcacctgctcgtcatcttcatgctggaacaccagcacgctgtccgccaccttaagactggatatatcaaacgaccatccgcgatcgtctgacagatccggcaaggtattgtcgcgcggtgcaaccggagcgtcttcactgcgcaccgcttccgtctgcggcgtcagttggatcactgccccttttagcatcacctgcttaacgctcagttgatgactcagtagtggtaaaagcgccacgtccagacgcatgttgtcggcgcgaaccagtggctggcttgcgccctgggcggtgagagacattcgcccggagaggatactaagctgcggccagacgtgccaacgcagtggcccgtcgagctgcaattgataaccgctacgtgcagcaacttgcttgaccatatagtcgcggaaatcattcggattcaccagcaacactaacgcagataacccggccaccagcacgaccaggagtatcatcagcgtcgtcagaaatcgtctcatggtatcctcaatgggcctgaattagtctttatcgattcggctggctaccgcgccctgctggttgcgatatttcgcatcttcacggcggttgtaaggtcgcaccgccgggccggaaagcggctcaaagctcagcgcaccaattaacatgcccggacgcagcgccagcggcagcttaccggagttgtagaactccagcacaatgcaaccagaccagcccggatcgatgcggtgcgcggtgacgtgcaccatcagccccagacgcgccagtgaggaacgcccgtccagccagcccaccagatcggctggcagcgtcaccgactccagcgtcaccgccagcgccagctctcctgggtgaagatagaacgcctcgccctcgtcgagaacgatctcatcgctcatcacgcggtcaagcgcggcgctcacttcatctttgggaccgctcagatcgataaacgctgccgtgtgaccacggaaggtacgaaatttattgcccaggcgtacatccaccgtcgcgccgttaatacgctccactggcggacgtgggttgatcgacaaacggccttcatcaagccaggcttcaatatctcggtcacacagacgcatggcattttctcctttcgcgcatcactcccttaacgccaattacgtcaagggcatactaggttatcactgaacggtacacaatttatcaagcttattcaaagaactgacttattttcgctttcaatatatcgatcgcgatgcggtttttcccgccgcgcggcacgataatgtccgcatattgtttagaaggctcaatgaattgcaggaacatcgggcgcacggttttttgatattgcgccatcactgaatccattgaacgcccacgctcgttaacgtcacgcttgatgcggcgcatcaggcagatatccagcggggtatcaacgaaaatggagaagttaagttcgtcacgcaaacgcgcatccgtcagcaacaaaatgccttcgagaatgatgaccttcttcggctcaaccgtcaccgtttctttcatacgcgtatgttcaacatagctgtaaaccggcaggtcaattgccgagccgcgtttcaacgcttgtaaatgctcaagcagcagactgtgatccatcgcgctgggatggtcgtagttggtcttaacgcgttcttccatcgacagatggctttgatctttgtaatagcagtcttcgggaattacgccgatgtgttcatcaccgacttgctcacgcaattcacgataaagggtactggcaataagactcttgccggaagccgatgcgccagcgataccgataatgacgcactgatgagactgatcagtcatatatttagcgacctgattaacctggatgttaggaagggggcgacgaagcgccaaacgcggcaattatagggatttcatccgtctgataccagtcgaatagcgttgccgcgcgctcagagttaattgttgacaaagaattcccgggggcaaattacgttgatcagttttatgtaaggtaaaaaatgttaaacgcagttgcgcaaattatccgcctttacgtcactttatgagcaattcgcatataaaatgtaaaacttttgtactagcataaacacagaaacgaatactggcgaccaggtcttgcggataaagcggtaatgagcaaacaatcacagcatgtattaattgccctgccccacccgctgcttcacctggtcagtttaggtttagtctcgtttatctttacccttttctcgcttgagctttcgcagtttggcacccaactcgccccactgtggttcccgacgtccatcatgatggtggcgttttatcgccatgccgggcgcatgtggccgggaattgcgctgagctgttcgctgggaaatatcgccgcatccatcctgcttttttccaccagctcgctgaacatgacctggacgaccatcaatattgttgaagccgtggtcggggcagtgctgctacgtaaattgctgccgtggtataaccccttgcaaaatctggctgactggctgcgtctggcactcggcagcgccattgttccgcctctgttggggggtgttctggttgtcctgctgacgcccggagacgatcctctcagggcatttttgatatgggtactgtcagaatccatcggcgctctggcactggtgccgctgggattgttatttaaaccacactatctgctgcgccatcgcaacccacggttgctttttgagtcgctgctcacgttagccatcacactgacgttaagctggctttcgatgctgtatctgccgtggccttttactttcattattgtgctgttgatgtggagcgccgtgcgtctgccacgaatggaagcctttttgatcttccttaccacggtgatgatggtgtcgctgatgatggccgcggatccctccctgcttgctacgccgcgtacgtacctgatgagccatatgccgtggctaccgtttttgctgatcctgctgcccgccaacatcatgaccatggtgatgtatgcctttcgtgcggaacgcaaacacatttccgaaagcgaaacccactttcggaacgcgatggaatattccgctatcggtatggcgttagtgggcaccgagggacaatggctgcaaaccaacaaagcgctctgccagtttctcgggtacagtcaggaagagctgcgcggactcacctttcagcaactgacctggccggaggatctcaataaagatctccaacaggttgaaaagctgataagcggtgaaataaacacctattcaatggaaaaacgctactacaaccgcaatggcgatgttgtctgggcgttgcttgccgtctcactggtgcgccacacggatggcacgccgctctattttatcgctcagattgaagacattaacgagctaaaacgcaccgaacaggtcaatcagcaactgatggagcgcatcactctggctaacgaagcgggcgggattggcatctgggagtgggagttgaagccgaatatttttagctgggataagcggatgttcgagctgtatgaaattcctccacatatcaaaccgaactggcaggtgtggtacgagtgcgtgctgccggaagatcgccagcatgccgaaaaagtgattcgtgattcgttgcaatcacgctcgccctttaaactggaatttcgcattaccgtaaaagacggtattcgccatatccgcgccctcgccaaccgggtactgaataaagaaggcgaagtcgaacgtctcctcggcatcaatatggatatgaccgaagtgaaacagcttaacgaggcattgtttcaggaaaaagagcgcctgcacattacgcttgattccatcggtgaagccgtggtctgtattgatatggcgatgaaaattacctttatgaatccagtggcggagaagatgagcggctggacgcaggaagaagcgttaggtgttccgctcctgacggtgttgcatattacttttggcgacaacggaccattaatggagaacatttacagtgccgacacctcacgttccgcgatcgagcaagatgtggtgttgcactgtcggagcggcggcagttacgacgtgcattacagtattacgccgttaagtactctggacggcagcaatattggttcggttctggtgattcaggacgttaccgaatcacgcaaaatgctgcgccagctgagctacagcgcctcccatgatgcactgacgcatctcgccaaccgcgccagttttgagaaacaactgcgtatcctgctgcaaacggtaaacagtacacatcagcgacatgccctggtgtttatcgatcttgatcgctttaaagcggtgaatgacagcgccgggcatgcggcgggtgacgctttgctgcgcgaactggcgtcgttaatgctgagtatgctgcgttccagcgacgtgctggcgcgactcggtggggatgaatttggtctgctgctaccagactgtaatgttgaaagcgcgcgttttatcgctacacgcattatcagtgccgtgaatgactatcactttatatgggaaggccgtgtgcatcgggtaggtgccagtgccgggattaccttgattgatgacaacaatcatcaggcggcagaagtgatgtcgcaggctgatatcgcctgttatgcctccaaaaatggtggccggggccgggtgacggtttacgaaccgcagcaagctgccgcacatagcgaacgggcggcgatgtcgcttgatgaacagtggcggatgattaaagagaatcagttgatgatgctcgcccacggtgtcgcttcgccacggatcccggaagcgcgtaatttgtggctgatttcacttaagctctggagttgcgaaggcgagattattgatgaacaaacatttcgtcgtagcttcagcgatccggcgcttagccatgctcttgaccgccgggtattccacgaatttttccagcaggccgcaaaagcggttgccagtaaaggcataagcatctccctccccctttccgttgccggtttgagtagcgccacgctggtgaatgatctgcttgagcagctggaaaatagccctctaccaccacggttattacatctgattattccggctgaagcgattttagatcacgcagaaagcgtgcaaaaactgcggctggcgggatgtcggatagtgctcagccaggtgggccgcgatctgcaaatcttcaactcgctgaaagcgaatatggcagattacctgctacttgatggtgagttatgcgccaacgtgcagggtaatttgatggatgagatgctgattacgattattcaggggcacgctcagcgactcgggatgaaaaccatcgccgggccagtcgttttacccttagtgatggatacgctttctggcatcggcgtcgatctgatttatggtgaggtgattgccgatgcccaaccgctggatttgctggtgaatagtagttatttcgcgattaactgaggcgtgcttccccatcgcctgatgcgacgctaacgcgtcttatcatgcctacaaatcgctcattccccaggccggataaggcgctcgcaccgcatccggcgaccaacgtcatgcttcgtctggttgccagccttccgtataccagatatgcaacagcgcataagaacgccagggcttccagcgctcggcataacggcggatttgcgccggtgtcattcccggaaatcgctgtttaatcagataatcatccggcaggaaaacatctttcgcctgccagccacgcaaagcaaaataattcgccgtccagcgcccgatacccggaaaagtttgcagcgttttcatcgcctgctccacatcgcccggtattgtcattggtaaggtgccctccagcgccgcatttgccagatgaatcagcgcctctgcccgtttcaacggcatacctaacgcttttaatgcctgcgggtctgctgctgccagccgctgaggcgtcgggaagcagatatactccggaaaatcatccagccgttcgccataaagctgtgccactctggcggtcaattttgccgccatcgccacgctcaccagttggcctaaaatcgcccgcacgccctgctcaaaagcatcaacacagccgggtaaacgcaatccgggccgcgccgcgcctaacctgcccaacgcaccgttaacaatttgtgggttacattgcagatcaaacaggcggctcattttcgccagacactctgcggcaacaggttctaaacctgcacttaaatttatgtgcagagtatggcgggctatatccggaatagcagtcaccacgccgcgatattcgcccaccgccagactacgggcataataactgtccgcgaccgtttccacactgctcaccgcacgggcggcgagaaatcccaacatccacgaccagtcatacggcggctgccagttcagggtatacatcgcatctccttattcatccgctttcagcataaacgttattcagacgctgcgctttgctttcatattccggttgtcgcgacggcaacatttcgctaaagtcacgccccttcttcaccggcatggggattatttcgtgtttattggttttgattacggtacagcaaactgttcagtggcggtcatgcgtgacggtaaaccgcatttgctaaaaatggaaaacgacagcacgctgctgccttcaatgctttgcgcgccaacgcgtgaagcggtaagcgaatggctgtaccgccatcatgatgttccggcagacgacgatgaaacgcaggcgctgttacgtcgggcgattcgttataaccgcgaagaagatatcgatgttacggcgaaaagcgtgcagttcggtctttcctcactggcacagtacattgatgatccagaagaagtgtggtttgtgaaatcaccaaaatcgttcctcggtgccagcggcttaaaaccgcagcaggtagcgctgtttgaggatctggtctgcgcaatgatgttgcacattcgccagcaggcgcaggcacagctgccagaagcgattactcaggcggtgattggtcgtccgatcaacttccaggggctgggcggtgatgaagcaaacacccaggcgcaagggattctggaacgcgcggcgaagcgtgccggattcagggacgtggtattccagtacgagccggtcgcggctgggctggattacgaagccaccttgcaggaagaaaaacgggtgctggtggtggatatcggcggtggtacgactgactgttcattgctgctgatggggccgcagtggcgttcgcgtctcgatcgtgaagccagcctgctgggtcacagtggttgccgtattggcggtaacgatctggatatcgcgctggcgtttaaaaacctgatgccactgctgggtatgggtggcgaaaccgaaaaaggcatcgccctgccgatcctgccgtggtggaatgcggttgccatcaacgacgtacctgcgcagagtgatttctacagtagtgccaacggtcgtctgcttaacgatctggtacgcgatgcccgcgaaccggaaaaagtggccctgttacagaaagtctggcgtcagcgtttaagctatcgcctggtgcgtagcgcagaagagtgcaaaattgctctttcaagcgtagcggaaacccgcgcctcactgccgtttatcagcaatgaactggctacgctgattagccagcgagggctggaaagcgccctcagccagccactgacgcggattctggaacaggtgcaactggccctggataacgcccaggaaaaaccggacgttatctacctgaccggcggtagcgcccgttctccgctgattaaaaaagcgctggcagaacagttgccgggcattccgattgcaggcggcgatgactttggctccgtcaccgccgggctggcacgctgggcggaagtggtgtttcgttaattgaaaaatggctcagcagcggcttaaatctgcctgcgcctgagccagtttttctgctgcctgacgtaacggttccatcaacggcatggtccgtgctggagcatgaaggcggaatcgctgcaactctgtcgcgccgactgtcaacgccgattccagccgatgtcgtttggcggtcattttcgccattaccgcttgtctgtctgctggcgttatcgcttcattcggcctgaacacaaaacggcgttcacagctcgctttccagtcgataaccgcctgggtcagatggtcgccaaaccctttcacttgcttaacgccacgacgggtaacatctgcggctgtttcaataccaaaagaccgtaacgccgctttacgcgcagggccaacgccgggaatagaggcaacatcaataaaaaatccctccagaaacttctgcttctgccgttcccttgcagtgtcatgaagtgctgccagagcgcgtttctcttcttccggtaacccgagaatttcgtccttcattttttcgagcatcgtccgtttggcgataaaaccttccaggccgcctacctgctggatctggcggactaaatggtcatagtccattttcgcacgattaaatgcctcacggcgttgctgaacttctgctttgtacgctttgcttgtcagactgccaataatccagatagccgccagcacaggaaccaaaataatataacgcggttctgcctgaaggccgcaaagcagcagcgataatgctgacagtgcgatctcaagcagaatgatgtattcgcgccgtaacaggcctaaaggaagcggcctgccagtcggttggaaatgatcgggtaatggcagttgcaatgctggcggtgctactgacgccatcaccatcgcccagactttcgccagcacaaaattcccgccggtggtaatgacctcttcgccgagatcaataaaatagataacaccttgattatccagcgcacaccacgggcagtcagtcaaatgagcggggtaaacatgcattgctgaaacgatacatttctttaactgttggcgtagagagtccagtgccgctacccacgctttagccgtcggacgcccggttgccacgccactttccgtgaatgcctgctgaaacatggcttcaacatcactcggtaacatcgatagcggaatagatcgtggcggcggttttaaaccacgtcgctgattatctgacgcgtaggcataacggaaatgggtaatatccgtctccagcgcattacccgcatcagagataagcggcacaccagaataaggatgccgcccaccaaacaagacgtgaaaaattagcaacgcaaggccaaaattatcgtgattttctgtgcgttcaaaaccgacaaatgatggcaaggtttgtagctctggcggcgtaaaatgcgacacgccgacttcgcataaatgcagtgtgccattggcgttaatttgaaaggagtcgctatcaatcagtaccactttgctgtcgcgacctaccataaaactgttctggtttacgtcacccacgacgtgcccgtgctcgtgaaccgtagcaaaagatgaagcaatattgcgcgcaacatagagtagaaaatcccacgcacaatgagggtaactctggcgacgatgtgccgggctatagatcatatgaatcggttctttaccagaaacttttggcatcataaaaccgataacttttccgcctcgtccaccgtgaagcgttgcctgcggccaggcgacataattcaacaactgcgcgtcagctgtcgcagccataaaggcaagtttgtcctgttttaaggcgggtggcggcgtgtgataaatcttggcgacgctatcgacaaactcctcgatatcataaaccgcgccttcaccacctttgcccagttcacggccaagagtggtcaattcacctgtcgatgtaaatacttttatatttgttttcataatatttcgcgggtagttatattatatttcaatgaataataacaactaaccattaaaattatttctatatggggaaaacccactcaagaataaaaatgataatgcaattttatcaggatacaattcaatttcggcctgataatgattaacttccacaggtttttgctaactttgactacaaagggattctggagaaaaaatgaaaaagatattacttatgttgagtctgctattttttactaccgcgggctttagtgaagtttcggatacgttagtgacgggaggttatgataaacaagcgatgtctgacgcgattaaacatgcgcggaaagaaaccgataaattcatcgaggttatgaataaaaaagatgccgatactttcgcagtcaaagccccgataaccgatcacggaagaaccgagcatttctggcttacggatgtcacttattctaacggcatgtttattggcgtaatcagcaatgaccctggtattgttacaaacgtagaatatggccaggagtggaaaatcaagaaagaagatatttcagactggatgtatacgcgcggggataaaatttacggcggttataccattgatcctttattggtcacctatccaaaagaagaagccgacgagctaagagcaaaattagttcgctaatcagccgttatatttattgtttaaactggcggttgaattgttgtcttcaaccgccatgagaaactcactctgcccacagcgccagtgccaacgttttatcatcatccgtacgctcgtttaccgccgggctggacaaaaactgctttaacaattcaggtaataaatcgagttgttcctgcgttgctgccgccagtccattgaaaaacggggtaaagaaaggcacatgaggagaattatccagcatatttaacgccagtcgctggataccatccgtaaatgctgcaactttgtgcgcacgcccagtgctggtgaaagtttccagtctggaaacggcatcttcgtcggtaatgaagtgcgtcatgttggcatattcacccgccatcggcgtgagaggcaattgcagaccgtgacccaaatctaccaccacgccgccatcgccaatctgcataatcaaggtgccgtcaggcgatgaaatcagtcccagaaatgtgcaggcaaaatcgcgaaccgctaattctttggcttccgcctcggcaaaaagtcgttgacgaatggtcagtaccatatttgtggcgaggacatcattaagccccaattccccgccctgcactttttgcgacatataagccatcgcttcattgacggcgagcatcgcgccttcgccaccctgcgagacactgcctgcgccatcagcgacaaataccgacaataatggctgctggtcatttaaccaggcaatctgcatctggcaggcatcctgacaaggcaagtccgcgctgatgtgcgacgttccaacggttgatgcatagaccagacgccagctcacactgacgtccagccttttggcgcttccagcacaacttccgttcccggcgtggagcgggaaaccgaacgcagcgaactggataaccagctaaacagttcacggaattgtaatccttgcagaggcaaaggctgacgaacgctaatttgtgccagcgtcttcatatccgccccctgaacaccgatggaaaagaaagcaaaccttttatcttcttccccccgaaacactttgttggctgcagcctgccactcatcggttggtgcaccatcggtaatcaggaaaatccacgggcgataatacgaaataccatttgcacgatactcacgtttccgctcctctaccatatccagggctttggtaatggccgcacccattggtgtatcgccctgggcaaacaggatgggcggaaaaaaattagcggcgctggtaaagggttgttccacatgcaccgggccgaacgtcacaatgccgagttccactctttttaaagccagcggatcagcaagcagttcatcacgaaaggtaaccaatccggcgttaagttcattaataggtctaccgttcatagaaccagaaacatccagcagcaaaatgcaggggcaacgtggttccgggttactggcaaaatcgctggtggcaaacgtgatttgttcgctcataagaaatcctttcttagagaattatcgaggtccggtatcataccgactgcaataatgaaataagagcaaacgaagaaactttcagaattaggcccggcggcgcagaaaattttgctattcgcctcgcaagaacggagagccgtcgattgacactaagggcggagtgacataatttcaggagtgagggttagggagaggtttccccctccccctggtgttcttagtaagcctggaagctaatcactaagagtatcaccagtatgatgacgtgcttcatcataaccctttccttattaaaagccctcttctccgggagaggctttcccgtttcagcgtcccgctgaaatcatcggcttacctcctttcgccctgaatgcagtctatcgctaacgcgtgaataaaatagtttcctctgtgattattgcgtaacgactcgcaaagaatatttgctggcaggatcgcagactacaaagcctgcggattgacaatcttatcgtgaaggcatactttcaggagtgagggtagagcggggtttcccccgccctggtagtcttagtaagcggggaagcttatgactaagagcaccacgatgatgagtagcttcatcatgaccctttccttatttatggccccttcctcgggaggggctttcccgtttcagcgtcccgctgaaatcgtcggcttacctcctttcgccatgcaagcagtctatcgctaacgcgtagataaaatagtttcctgtgttattactggatgcgtgctcgcaaatgtgcccgtcattcagacgattccagacagtgtttcataattcctccatttttctcccttattggctggctacactagtatcattccgcgaaacgtttcaggaagagaaactcttaacgatgaaaggtagttataaatcccgttgggtaatcgtaatcgtggtggttatcgccgccatcgccgcattctggttctggcaaggccgcaatgactcccggagtgcagccccaggggcgacgaaacaagcgcagcaatcgccagcgggtggtcgacgtggtatgcgttccggcccattagccccggttcaggcggcgaccgccgtagaacaggcagttccgcgttacctcaccgggcttggcaccattaccgccgctaataccgttacggtgcgcagccgcgtggacggccaactgatagcgttacatttccaggaaggccagcaggtcaaagcaggcgatttactggcagaaattgaccccagccagttcaaagttgcattagcacaagcccagggccaactggcaaaagataaagccacgcttgccaacgcccgccgtgacctggcgcgttatcaacaactggcaaaaaccaatctcgtttcccgccaggagctggatgcccaacaggcgctggtcagtgaaaccgaaggcaccattaaggctgatgaagcaagcgttgccagcgcgcagctgcaactcgactggagccggattaccgcaccagtcgatggtcgcgttggtctcaagcaggttgatgttggtaaccaaatctccagtggtgataccaccgggatcgtggtgatcacccagacgcatcctatcgatttagtctttaccctgccggaaagcgatatcgctaccgtagtgcaggcgcagaaagccggaaaaccgctggtggtagaagcctgggatcgcaccaactcgaagaaattaagtgaaggcacgctgttaagtctagataaccaaatcgatgccactaccggtacgattaaagtgaaagcacgctttaataatcaggatgatgcgctgtttcccaatcagtttgttaacgcgcgcatgttagtcgacaccgaacaaaacgccgtagtgatcccaacagccgccctgcaaatgggcaatgaaggccattttgtctgggtgctgaatagcgaaaacaaggtcagcaaacatctggtgacgccgggcattcaggacagtcagaaagtggtgatccgtgcaggtatttctgcgggcgatcgcgtggtgacagacggcattgatcgcctgaccgaaggggcgaaagtggaagtggtggaagcccagagcgccactactccggaagagaaagccaccagccgcgaatacgcgaaaaaaggagcacgctcctgatgcaggtgttacccccgagcagcacaggcggcccgtcgcgcctgtttattatgcgtcctgtggccaccacgctgctgatggtggcgatcttactcgccgggattatcggttatcgcgccctgcccgtttcggcgctgccggaagtggactatccgaccattcaggtggtcacgctctacccaggtgccagcccggatgtcatgacctctgccgttaccgcgccgctagaacgccagttcgggcagatgtctggcctgaaacagatgtcgtcgcaaagttccggcggtgcgtcagttatcactttgcagttccagctaacattaccgctcgatgtcgccgagcaggaagtgcaggccgcgattaacgctgcgaccaacttgttgccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcgccaattcgtctgggcgatgtcgcaactgtagagcaaggtgcagaaaacagctggctcggcgcgtgggcgaacaaagaacaggccattgtgatgaatgttcagcgccagcccggtgctaacattatctccaccgccgacagcattcggcagatgctgccacagctcactgagagtctgccgaaatcggtgaaggtgacagtgctttccgatcgcaccaccaatatccgcgcatccgtcgatgatactcagtttgaattgatgatggctatcgcgctggtagtcatgattatctacctgtttttgcgcaatattccggcgaccatcattcccggtgttgctgtaccgctgtcgttaatcggcactttcgcggttatggtgtttctcgatttttcaatcaataacctgacactgatggcgttaactatcgccaccggattcgtggtcgatgacgccatcgtggtgatcgaaaacatttcccgctatatcgaaaaaggcgaaaaaccgttggcggcggcgctcaagggcgcaggtgaaatcggctttaccattatctcgctgaccttctcactgattgcggtgttgatcccactgctgtttatgggcgatatcgtcgggcgactgttccgcgaatttgctattaccctggcggtagcgattttgatctcagcggtggtgtcgctgaccctgacaccgatgatgtgcgcgcggatgctcagccaggagtcgttgcgtaaacagaaccgcttctcccgtgcctcggaaaaaatgttcgacaggataatcgccgcctatggtcgtggactggcgaaagtgctgaatcatccgtggctgaccttaagcgtggcactcagcacgctgctgcttagcgtgctgctgtgggtgttcattccgaaaggtttcttcccggtacaggacaatggcattattcagggcactttgcaggcaccgcaatccagctcctttgccaatatggcccagcgacaacgccaggtcgcggacgtgattttgcaggatccggcagtgcaaagcctgacctcatttgttggcgttgatggcactaacccgtcgctgaacagtgcacgtttacaaatcaacctcaaaccgttggatgaacgtgatgatcgggtgcaaaaagtcatcgcccgtctgcaaacggcggtagataaagtgccgggcgtcgatctcttcctgcaaccaacgcaggatctgactattgatactcaggtcagccgcacccagtaccagtttaccttgcaggccacgtcactggatgcgctcagtacctgggtgccacagttgatggaaaaactccagcaactgccacagctttctgatgtctccagcgactggcaggacaaagggctggtggcgtatgtcaatgttgatcgcgacagcgccagccgtctggggatcagcatggcggatgtcgataacgccctgtacaacgcgtttggtcagcggctgatttccactatttatactcaggccaaccagtatcgcgtggtgctggagcacaacaccgaaaataccccaggcctcgcggcgctggataccattcgcctgaccagcagcgacggcggcgtggtgccgctaagctcaattgccaaaattgagcagcgttttgcgccgctctccatcaaccatctggatcagttcccggtaacgaccatctcctttaacgtgccggataactattcgctgggcgatgcggtgcaggcgattatggacaccgaaaagacgctgaatctgccggtggatatcaccacgcagttccagggcagcaccctcgccttccagtcggcgctgggcagcactgtctggctgattgtcgcggcggtggtggcgatgtatatcgtgctcggcattctgtacgagagctttattcacccgatcaccattctctcgacgctacccaccgcaggggttggcgcactgctggcgttgctgattgctggtagcgaactggatgtgattgcgattatcggcattattttgctgatcggtatcgtgaagaagaacgccatcatgatgatcgacttcgcgctggctgctgagcgcgagcaaggcatgtcgccgcgcgaggcaatctaccaggcttgtctgttgcgttttcgtccgatcctgatgaccactctggcggctctgcttggcgcgctgccgctgatgttgagtaccggggtcggcgcggaactgcgtcgtccgttaggtatcggcatggtcggcggtctgattgtcagccaggtgctgacgctgtttaccacgccggtgatttatttgctgttcgaccgcctggcattgtggaccaaaagccgctttgcccgtcatgaagaggaggcgtaagtgaagttttttgccctcttcatttaccgcccggtggcgacgattttactgtcggttgccattaccctgtgcggcatactgggcttccgtatgctgccggtcgccccgctgccgcaggtcgattttccggtgattatcgtcagcgcctcgctgcccggtgcgtcaccagaaacaatggcgtcttccgttgccacgccgctggagcgctcacttgggcgcattgccggagtcagtgaaatgacctccagcagttcgctcggcagcacgcgtattattttgcagtttgattttgaccgggatatcaacggcgcagcgcgtgatgtgcaggcggcgatcaacgctgcacaaagtttgctgcccagtgggatgcccagccgcccgacctatcgcaaagcgaacccgtcggatgcgccaattatgatcctcacgctgacgtccgatacttattcgcagggtgaactgtacgatttcgcctcgacgcagctggctccgacgatttcgcaaatcgacggtgttggtgatgtcgatgtcggaggcagctcactgcccgccgtacgcgtcgggctgaatccgcaggcgctgtttaatcagggcgtgtcgctggacgacgtacgcaccgccgtcagcaatgccaacgtgcgtaaaccgcagggcgcgctggaagatggcactcaccgctggcagatccagaccaatgatgagctaaaaaccgccgctgaatatcagccgttgattattcactacaacaacggcggcgcggttcgtctgggcgatgtggcgacggtgaccgactcagtgcaggatgtgcgcaacgccgggatgaccaacgccaaaccggctattttactgatgatccgcaaactgccggaagccaatattatccagacggttgacagcatccgggcaaaattaccggagttgcaggaaaccattccggcggcgattgatctgcaaattgcccaggatcgctcccccaccattcgcgcctcgctggaagaagtcgagcaaacgctgattatctcggtggcgctggtgattctggtggtgtttttattcctgcgctcgggtcgcgccactattattcccgccgtttcggtgccggtttcgctgattggtacgtttgcggcgatgtacctgtgcggattcagtctcaataacctttcgttaatggcgctcaccatcgctactggtttcgtggtggatgacgccatcgtggtgctggaaaacattgcacgtcatctggaagcgggaatgaaaccgttgcaagccgcactgcaaggtactcgcgaagtcggttttacggtgctgtcgatgagtctgtcactggtggcggtgttcctgccgctgctgttgatgggcggattgccgggccgactgttacgcgaatttgccgtgacgctttctgtcgccattggtatatcgttgctggtttctctgacattaacgccaatgatgtgtggctggatgctgaaagccagcaagccgcgcgagcaaaagcgactgcgtggttttggtcgcatgttggtagccctgcaacaaggctacggcaagtcactaaaatgggtgctcaatcatacccgtctggtgggcgtggtgctgcttggcaccattgcgctgaatatctggctgtatatctcgatcccgaaaaccttcttcccggagcaggacactggcgtgttgatgggcgggattcaggcggatcagagtatttcgtttcaggcgatgcgcggtaagttgcaggatttcatgaaaattatccgtgacgatccggcagtggataatgtcaccggctttacaggcggttcgcgagtgaacagcgggatgatgtttatcaccctcaagccacgcgacgaacgcagcgaaacggcgcagcaaattatcgaccgtctgcgcgtaaaactggcgaaagaaccgggggcgaatctgttcctgatggcggtacaggatattcgcgttggtgggcgtcagtcgaacgccagctaccagtacacgttgttatccgacgacctggcggcactgcgagaatgggagccgaaaatccgcaaaaaactggcgacgttgccggaactggcggacgtgaactccgatcagcaggataacggcgcggagatgaatctggtttacgaccgcgacaccatggcacggctgggaatcgacgtacaagccgccaacagtctgttaaataacgccttcggtcagcggcaaatctcgaccatttaccagccgatgaaccagtataaagtggtgatggaagtggatccgcgctatacccaggacatcagtgcgctggaaaaaatgttcgttatcaataacgaaggcaaagcgatcccgctgtcgtatttcgctaaatggcaaccggcgaatgccccactatcggtgaatcatcagggattatcggcggcctcgaccatttcgtttaacctgccgaccggaaaatcgctctcggacgccagtgcggcgatcgatcgcgcaatgacccagcttggtgtgccttcgacggtgcgcggcagttttgccggcacggcgcaggtgttccaggagacgatgaactcgcaggtgatcctgattatcgccgccatcgccacggtgtatatcgtgctgggtatcctttacgagagttacgtacatccgctgacgattctctccaccctgccctcggcgggcgttggagcgctgttggcgctggagctgttcaatgccccgttcagcctaatcgccctgatagggatcatgctattaatcggcatcgtgaagaaaaacgccattatgatggtcgattttgcgcttgaagcccaacggcacggtaacctgacgccgcaggaagctattttccaggcctgtctgctgcgttttcgcccgattatgatgactaccctggcggcgctgtttggtgcgctgccgctggtattgtcgggcggcgacggctcggagctgcggcaacccctggggatcaccattgtcggcggactggtaatgagccagctccttacgctgtataccacgccggtggtgtatctctttttcgaccgtctgcggctgcgtttttcgcgtaaacctaaacaaacggtaaccgagtaaatgacagatcttcccgacagcacccgttggcaattgtggattgtggctttcggcttctttatgcagtcgctggacaccaccatcgtaaacaccgcccttccctcaatggcgcaaagcctcggggaaagtccgttgcatatgcacatggtcattgtctcttatgtgctgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgttacagggcgttggcggcgcgatgatggtgccggtcggcagattgacggtgatgaaaatcgtaccgcgcgagcaatatatggcggcgatgacctttgtcacgttacccggtcaggtcggtccgctgctcggtccggcgctcggcggtctgctggtggagtacgcatcgtggcactggatctttttgatcaacattccggtggggattatcggtgcgatcgccacattgctgttaatgccgaactacaccatgcagacgcggcgctttgatctctccggatttttattgctggcggttggcatggcggtattaaccctggcgctggacggcagtaaaggtacaggtttatcgccgctgacgattgcaggcctggtcgcagttggcgtggtggcactggtgctttatctgctgcacgccagaaataacaaccgtgccctgttcagtctgaaactgttccgtactcgtaccttttcgctgggcctggcggggagctttgccggacgtattggcagtggcatgttgccctttatgacaccggttttcctgcaaattggcctcggtttctcgccgtttcatgccggactgatgatgatcccgatggtgcttggcagcatgggaatgaagcgaattgtggtacaggtggtgaatcgctttggttatcgtcgggtactggtagcgaccacgctgggtctgtcgctggtcaccctgttgtttatgactaccgccctgctgggctggtactacgttttgccgttcgtcctgtttttacaagggatggtcaactcgacgcgtttctcctccatgaacaccctgacgctgaaagatctcccggacaatctggcgagcagcggcaacagcctgctgtcgatgattatgcaattgtcgatgagtatcggcgtcactatcgccgggctgttgctgggactttttggttcacagcatgtcagcgtcgacagcggcaccacacaaaccgtctttatgtacacctggcttagcatggcgttgatcatcgcccttccggcgttcatctttgccagagtgccgaacgatacgcatcaaaatgtagctatttcgcggcgaaaaaggagcgcgcaatgaagttctggcgacccggtattaccggcaaactgtttctggcgattttcgccacctgcattgtcttgctgatcagtatgcactgggcggtgcgtatcagttttgagcgtggctttattgattacatcaagcatggtaatgaacagcgattacaactgttaagtgatgcgcttggcgagcagtatgcgcagcatggcaactggcgcttcctgcgcaacaatgatcgctttgtctttcagatcctgcgttcatttgaacacgataattcggaagataaacccggcccgggtatgccaccgcacggctggcgtacccagttctgggtggttgatcaaaacaacaaagtgctggttggtccgcgagcgccgattccacctgacggtacacggcgacccattctggtcaacggtgcggaagttggcgcggtgatcgcctcccccgttgagcggttaacgcgcaatactgatatcaatttcgataaacaacagcggcaaaccagctggttgattgtcgccctggcaacgttactcgcggcacttgccacttttctgctggcgcgcggtttactggcaccggtaaaacgacttgtcgatggcacgcacaaactggcggcgggcgatttcactacccgcgtaacgcccaccagtgaagatgaactgggcaaactggcgcaagacttcaaccagcttgccagcacactggagaaaaaccagcaaatgcggcgcgattttatggccgatatttctcacgaactgcgtacgccattagcggtgctgcgcggtgaactggaagccattcaggatggcgtgcgtaaattcacgccggagacggtggcgtctttacaggcggaggtcggtacactgaccaaactggttgacgatctccatcagttgtcgatgtctgatgaaggcgctctcgcctatcaaaaagcaccggtagatttgatcccactgctggaagtggcgggcggcgcatttcgcgaacgattcgccagtcgtggcctgaaactgcaattttccctgccagacagtattaccgtatttggcgatcgcgaccgtttaatgcagttattcaataacttactggaaaacagcctgcgctacactgacagcggcggcagcctgcaaatctctgccgggcagcgcgacaaaacggtgcgcctgacctttgccgacagtgcgccaggtgtcagtgacgatcagctacaaaaattgtttgaacgtttttatcgcaccgaaggttcccgcaaccgtgccagcggcggttccgggctggggctggcgatttgcctgaacattgttgaagcacataatggtcgcattattgctgcccattcgccttttggcggggtaagcattacagtagagttaccgctggaacgggatttacagagagaagtatgaccgagttaccaatcgacgaaaacacaccgcgtattttgatcgtggaagatgaaccgaagctggggcagttgctcattgattatctgcgtgctgcgagctatgcgccgacgcttatcagccacggcgatcaggtactgccgtatgtgcgccagacaccaccggatctgatcctgttagatctgatgctccctggcaccgatggcctgacgctgtgccgggaaattcgtcgtttttctgacattccgatcgtgatggtgacggcaaaaatcgaagagatcgatcgcctgctggggctggagattggcgcagatgattatatctgtaagccgtacagcccacgggaagtggtagcgcgcgtcaaaaccattttgcgccgttgcaaaccgcagcgcgagttgcagcaacaggatgctgaaagcccgttgattatcgacgaaggtcgttttcaggcttcatggcgcggtaaaatgcttgacctgacgcctgcggaatttcgtctgctgaaaacgctctctcacgaaccaggaaaagtgttctcccgcgagcaattgctcaatcatctttatgacgactaccgcgtagtaaccgaccgcaccatcgacagccacattaaaaacctgcgccgcaagctggaatctctcgacgccgaacagtcatttatccgcgccgtttatggcgtcggttaccgctgggaagccgacgcctgccgcatcgtttagttttagcgacattattttgttagccggagatggcgttcagaccagatccggcaacattatcccacgcatggtcagcaaactgacattatctctccgccctggcaggcatcagaaaatcgctcatactttaatcggtaaacagcacctttagatgctgttttcgatacacaatttcaatcaaggagtcattatggctggttggtttgaactcagtaagagcagtgataatcagttccggtttgtgctaaaagcgggcaatggtgagactatcctcaccagcgagctttatacctcaaaaacctctgcggaaaagggcatcgcgtcggtgcgtagcaacagcccgcaagaagaacgctatgagaaaaaaacggcaagtaacggcaaattctatttcaatctgaaagccgctaatcatcaaattatcggctccagccagatgtacgccaccgcgcaatctcgtgaaaccggaattgcctccgttaaagccaatggcacaagccagacggtgaaagacaatacgtaattacgatgccgggcgtgggttgttggcgtccggcgctttaccagagccccccacagcgctacaatgcccgcccttaaagtgggggcactcccctaaccgcttcatcaggtgaagcggatctgacctgtcatcagaacgagagaattatgtttaaaccggaactcctttccccggcgggaacgctgaaaaatatgcgttacgctttcgcttatggcgcagatgctgtttatgcgggccagccgcgttattccctgcgtgtgcgcaacaacgaattcaaccacgaaaatcttcagctcggcatcaatgaagcccacgcgctggggaaaaagttttatgtcgtggtcaacattgcaccgcacaacgccaagctgaaaacctttatccgtgacctgaaaccggtggtggaaatggggccggatgcgctgattatgtccgatccagggctgattatgctggtgcgtgagcacttccctgaaatgccgatccacctttcggtgcaggctaacgccgtgaactgggcgacggtgaaattctggcagcaaatgggcctgacccgcgtgatcctctctcgcgagctgtcgctggaagagattgaagagatccgcaatcaggtgccggatatggagatcgagatcttcgttcacggcgcgctgtgcatggcctactccggtcgctgcctgctctctggctatatcaacaagcgcgacccgaaccagggcacctgcaccaacgcctgccgctgggagtacaacgtccaggaagggaaagaagatgatgttggcaacatcgtacacaagtacgagccgattccggtgcaaaatgttgagccgacgctgggtatcggcgcaccaaccgacaaagtgtttatgatcgaagaggcccagcgtccgggcgagtatatgaccgcgtttgaagatgagcacggcacttacatcatgaactcgaaagatctgcgcgccatcgcccatgtagaacgcctgaccaaaatgggcgtgcattcgctgaaaatcgaaggtcgtaccaaatctttctactattgtgcacgcaccgcacaggtttaccgcaaagctatcgatgacgccgctgcgggaaaaccgttcgataccagcctgctggaaactctggaaggtctggcgcatcgtggctataccgaaggtttcctgcgtcgtcatactcacgacgattatcagaactacgaatacggttattcagtttctgaccgccagcagtttgttggtgagtttaccggtgagcgcaagggggacctcgcggcggtagcggtgaaaaataaattctccgttggcgacagccttgagctgatgacgccgcaaggcaacattaattttacccttgagcacatggaaaacgccaaaggcgaagctatgccgatagcaccaggcgatggttatactgtgtggctcccggtcccgcaggatcttgagctcaattacgcgctgctgatgcgtaatttctccggggaaaccacgcgtaatccccacggtaagtgattaatttcgattatttttcccggatggaaaattcttagaaaccgatcacatacagctgcatttattaaggttatcatccgtttcgctgaaaaacataacccataaaatgctagctgtaccaggaaccacctccttagcctgtgtaatctcccttacacgggcttattttttacgcgtaatacaatgaaataaaaggatttatttctggtcacgtccacacattgaccacatcgacaaaaaagcccctcgactgaggggcttcctgtttctaattacatccacataatttgctgccctgacggcaacgggtgcggccttacgacgtggacttctcccggcttcacaatgtatcgctgtaccgactcataagtgatgaacgtggcgctgcaattcacgttctgacactggtgataacgctcttttgtcgtgtcagtgatatagcggcttgtacgcgcatgtgcggcatgctggcataaaggacaatgaaacatcgcgagcacctcttccggttttgttgatggtgccattttagttaatttacccttacaaaacaaacagataaaataaaaacatcactcattatcttctgtttcgtaccccacatcagaaagcctgacctcaagctctaatgacgtcgtgaagccgctattattcagaaaatgtgtcaccttagtgattgtccagtcctgctcgtctatgacgcgcttaaagccagacactttgaccggtgtttccgtgtaaatatctgcccgaccggtagccaggctgatggagaactctgctacacgggcttatttttttatgcataagccctatctctggtaaccgtcttccattgaccacatcgatagaatcctccttcatagcacgatgcctttcacttatcggcatcgtgctcccacaggttccggctacgcacagccagaacgcgcatatttgacgcttaccaaaaaatattctcactctccacatttgaatgtcagacgagcgacaccatgtaatcctacaccttctgtcttcagctcaactatttgcatttttttgccctgagtaacacagaaatgagttgcatcattttttactatattttctgcaccagatattctacccctggctaaagaagcttcggcttcggtgtagtattggttatcgagtttacgctgaatattacttttatatgcaagaccaaatttaccgatacttgtctcatcattatgcacagcacaaccagacataataaaaatactaattaatgatatagcagctatctttttcatctcaccttcccccattaaataccaacgacactctctagtgtttaaatataataatggcatgattattataattgaataggattataataaatgttctgtacaacatttcctacataagtaggaattacggacattgaggcccttcagggtaactccatgggggctttaatatattatattgaagatgccactgtttagttgaatattaggtatatgctcttttttgaaatttatcggtggcagccgttagtattcgctgtccccattgcaagctcctggtggtaaccactgaatcctccatacttgaactgactttttatcctccgactttcatcctgttctgactccaccttttgttttctgctctacactatctacagaccaatcataaaggcacatacgatcatggcagaatttcccgccagcttactgattcttaatggcaaaagtactgacaatctacccttgcgcgaagcaattatgctgttgcgtgaggaaggaatgacgatccatgtgcgggtcacctgggagaaaggcgatgccgcacgatatgtagaggaggcccggaagtttggcgtcgcaacggtgattgccggtggtggcgatggcaccattaatgaagtttctacggcgttgattcagtgtgagggggatgacatacccgcgctgggaattttgccattaggaaccgccaatgattttgccaccagtgtagggattcctgaggcactggataaggcgctgaaactggcaattgccggtgacgccattgcgatagatatggcgcaggtcaacaaacaaacctgttttattaatatggcgacaggcggatttgggacgcgtattaccacagaaacgccggaaaaattaaaagccgcgctgggtagcgtctcttacatcattcatggcttaatgcgtatggatactctgcaaccggaccgttgtgaaatccgcggtgaaaactttcactggcaaggtgacgccctggtcattggtattggtaacgggcgtcaggccggtggcggtcagcaattgtgtccgaacgcgttaattaacgatggcttgctgcaactgcgcatttttaccggcgatgaaatacttccggctctcgtatcaaccttaaaatctgacgaagataacccgaatattatcgaaggcgcttcgtcgtggtttgatattcaggcaccacacgacatcacctttaatcttgatggcgaaccgttgagtgggcaaaattttcatattgaaatacttccggcagcgttgcgttgtcgattaccaccagattgtccactgttgcgttaatcaaactattctctcttgaaccagggagaatccgtaatgccggatgcggtgtaaacaccttatccggcatacagaacaatactacaccgtaattaattttacccgcgtcttctgcaatgccagtttatccacctctgacacagcatcatcggtaataataatgtcaattttttcgattggtagtacctgattaaaaccgcgacggttaaatttcgatgaatcgagaacggcaatcactttattagcggctgtgaccatcgcaccgctaatagaataaccttcattaaaggtcgtaataccattaaccgcatcaataccatcagcaccgacaaacattaaatcggcattaatatcctgtaatgaacgctcggcaatggaaccatgcatcgagcgcgttttatggcggaccgtgccaccacagacgaccagagtaatgtctttattttcggaaagggcaaacgctgccgggagactgttggtaatcaccgtgatatttttggcggtcattaatccttcggcgataagcattgtcgtacttccgctgtcgagaataacggtctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcagtcatcccttcgtggatcattttgactgccgcctgcgctattctgttttttggcgcgctggcgagctgaaatcgctctttaaacccgacttcctgggtctcggtttcactattaccagacattattttcgccgcaccgccatgaaagcgcgtaaccacgcctttttgttcgagaaagcgcaaatcggcacggattgtcgcttccgaggcagcaaatactcccgccagatcctgaacaagcacggttccctgttcattcactaattggatgatcttattccttcgctcgaatgaattcatcgtcatttacccatattcaattgtggctagtgtaaacgaagggggaccattggtgaatgatctgttttgcacaataccgggccagcatcacgctggcccgcggtttcagggaatgagcaacactttgcccggcatagcattacgagcgatgtcacgcaccgcctgggcgaagctttcaaagcttccacggtgagcgattaatggctccaggcttaacttacgttctgtcagcaaccggctcgccgtttcccactcctgccccggccaagggctggagtagttcatccaactgccgataaccgtcagctctttacgcaatattttgccaaacgttgccgatgttaaatgcagatcctgatgcaacgtgcccaccagcgccagttgggcatgaggaccggcaatctctaccgccagttcgacagtttgcggtacgccagccgtctcgaggataagctgattaaagcgcagttcgcgtaaaacgctctgcatttgcggcgcgctcatttcgctactgttaaatgtttgcatcgcaccgaaagattttgccagtgccagtttttctgaactaatgtcgatcgccgtcacactctttgctcccagcgcgacagcgcactgaatggccagcaggccaatggttccggcaccaataataataacgtttttattctcacaaccttgcgctaaatgaaaagcatgcagaccaacggtaatcggctcaataaaagccccatcctcaataggcatatccgtgggtagagcaaagacattttttcgcttaacgacaatatattcagcaaatccaccatcacgccgcgagccaataaaatcatattttgcgcactgggaataaaaccctttcagacactctggacaagtaaaacagggtaataacggcacacaggcaaccgcatcgccagggtgtaaatcatcaacaccggatcccaccgcatcaatatagccgctaaattcatggcctaacgttattggataataatgtgcaccatttttaaatatcctgggtaaatcggaaccacataagcccgagctggcaatttttacccgcacctcatcctgatgtttaatttcaggaatgacgctttctgcaacgcgcacgataccatcagtatcattcaccactgatttcataaaaactcctgattgttaagggggataacctccccctcaggtaaaaattattctgcgagaacgactttctcttgtttaataaagccacgcgctctacgccaggtcatgaaaataccggtcagataaattgcaccgataataatgaaaccgggaatattttgcggggagaaaacctgaatcagtaaccaggtaatgggagaaccgccctgatccattgaagccaccatacccccggcttttaacgccccagcattagccgccagttgggtgtgcaaaccaatagtttgcgtcgcgatccacagggtgatgctcataatgatgacacccgagattaaggtgcggaacagatttccacgatgcacggcgaccgccatcgccacgaagaagccgatggtggcaagatcgccaaacggcagcacctgattacccggcacacaaacagcaattaaaatggtgagtgggataaaaatcaggcttgccgataccaccgccgtatgtcccagcagcaacgccggatcaaggccaatcaggaactcctgaccgccgaacttcgcctgtaaacgactacgagcctgcttagcgatgggcgttaaaccatccatgatgggtttaatcacccgtggcattagcagcatcactgccgccgtttttaccgccagctgcaatacacctttgacatcgtaacccgcgaggatgccgataatcagccccatcacaaaacccacggtgacaggctcgccaaatggaccaaatttgcgctgaatatcgtcggcgctaaatttaattcggttaacgcctgggattttctcgatgatagcatcgaccagcaccgcaatcggccccatatacgccgacgtaccgtgcggaatagcaataccttccagctcaaagaaatttcgggtatcgcgggcaaaccagtcgccgagcttataaacaaacgccgcgtgaattaccacacctgccatccctatcatccatgaaccggttgccagatgcagcaacgcgccggtgaaggtcatatgccagatattccagatatcaacatttaccacccgcgtcatacgggtcagtaacatcgccacgttaaccagaatcgcaatcggaatcgccaccagcgcaatttgcgacgcccaggtcattggtgaagagcccggccagccaacatcgaccacatgcagattcaggtcgaaattttccgccatcgctttcgccgccgggccaatggaatccagcattaagccaatcacaaggccaatgccaacaaagccaatcccgatatgcagacccgctttaaagcaatcgcctgccttcatgcctaatattttagaaaaaataatgatgacaatcggcagcatcaccgtagggccgaggtcgagaatataacgcatgacttctgaaaacataggtcacccctgtaagatagtcagaattttattttgtaatgcttcgataccgataccagaaataaaaggcatgccgtgaactaacggaatatcgccaaaactacgatccactttggcagtggtgcatatcaaatgcacaccatccatataggtttctatttcattaacccgacactggattaattcaacaggaatattatgattctgacacaactctttaatttcttccgccgccatcgtagaggtcgcaaccgcgcctccgcaagcgacaataatcttgcgtttcataaatagtcctttttattgttacagagggatttattcgtctgaatctaaaacatactttgtgaagtattcctttaactgggtttcaggaagagtgattagtgtctcgacgatatcgggctgttgtaacttgccaaataaacagcgtaaaagtttcaattgctgctgcggattttccacaatcaacgcaataaccaacgataccgccacgtcgttatcatcatccgcttgctgaaaatgaactttatttgttggccttaacagataaatggctgacgacttagcatgaatcgcctcacaatgcggtattgcaatagcgtgctgctcaagcattatcccggtagggaattctgcttctctggcaattaatgcctgtggccaggtatcatgaaccacacctttggcgagcatctcattaccgatatgggttaaaacttcgctacgatcgacaaaagaaattccgctacgaacaaacaggttagtcatataccgtccttattccgcacagccgtagcgataggcgcgcaaaacatcataaattttatccataatcagctgatgcggtattgctgataattccccggactgaatgcgttcaaattgtttgggaagatactgactaatcatgcccagtgggatgtccacgccttcaagattcaccatcatcgtttcgacgctatttttaatccgactatgcggccagtaataacgaatacgatccgacaggctgtaacgaatatccagtaatgaatcgttaaaacccgtacgataatattttttccagtattgcggttcgtcgagcatcacttcttcaattaccgccaggcaaccgctgcgattttcaggggcgataagttcctgctcaatttgtgccagtgcaaatatcgcctcgcgtaaagcaaaggttaatgcgggaccgactttcaatattgcaaagtgatcgcggactaattcccaataagccgtccgggtctggtaatcggtagaatgtgcttcataaaccattcgggtgttttctatccattgcgccagcggctgcgcttcctgcggctgataatggataatattgctgtgatcaaattccacacccggctgcaccacgatggcaatcacacgtgttaacgcctctgtcagcccacgggcaataaaggccttttgatgcgtacgtaaagtattggcggcatcttcaacatgggtgatgtgtactgactgaatggcgctggcctcaccgcccggaaccggaacttcggtgccaatgacatagctcagttgctcacgctggcaatctgtcgccacactttccgcagcaaagcaaagcacagcagctcgttccgcaaccgtttctggtgctaacggtatgggatcccccgcgcaggacattgacgcatcaagatgaattttactgaagccggcacgaacatattcctttaccagctcgacggatttttccatcgccgcatccgcattttcttgctgccagcagtttggccccagatgatcgccgccgagaataatgcgttcgcgtgcaaacccaactttatcggcaatcgtaaaaacaaattcgcgaaagtctgccggtgtcattccggtataaccgccaaattgattgacctggtttgacgttgcttcaatcagcactttgcgcgtgctgttgcgatcaaatgccagcgccgcttcgataaccaacggatgggcagaacagactgaacatatgccgatatgttcaccagctttatgccgggcaattaacgttttcatgttttttccttgttaaatggcaggtgcgttatgccctgccctcgcagccacaatcggcaatcactttgctcaccacatcgcgcattgcggatttagccgactgcaaataatcccggggatcggtcgcttcagggtgctcggtcaggtaattttttaacgcctgcgagaaggcatttttcagctccgttgcaacgttgattttgcatatccccagtttgatggtttgctgaatatccttagtcgataaccctgacgcgccatgcagcaccagcggtaagttcacccactggcgaatgttctccagtctagaaaaatcaagcgccggtgcgctggcatacatcccatgagccgtgccgatggcgaccgccagggaatcaattccggttgcctcggcaaattcacgcgcctgagcggggttggtgtacaacgcatcggcttcattgacttgcacatcatcttcctggccgccaagttgccccagctccgcctcgacgctgacatcaaagcgatggcaaaaatccaccacctctttgacccgtgaaatattttgcgcaaaaggcaaatgcgaggcgtcaatcatgactgagcgcacgccagaacgaaccttctgagcgatatcgtcaaatttcgtgtgatggtcgagatgaattgccagtggatggtgatattgcttcgccatcgcgctgaccagcgccaacagattttctgtaccagcatgagtaaatgtgccaggcgttccggcgatgatgaccggcgcatgcaggttggcagcggtttctaccaccacttgcatcgtttcgagattgtgaatattgaatgccggaaccgcataaccgccgcgctgtgcgttgttcagcatctgctttgtcgataccacgtacattttcatatcctgtcgtttgttttcgatttcaaaatataatgaaattatttgtttttaaatatcgagataacgatcacaaaaacgacaatatgaaaattattcgaggagtgaaaggcaaaaaaacggcctcccgatagggaagccgtagcaaagtgcgcgtgtttttatgccggatgcggtgtaaacatacgtggcagtgctatgtaggcatgataagacgcttcagcgtcgcatcaggcataggttgccggatgcagcgtaaacgccttatccgtcctacggggtggtgttgttcgtataaggcgtatcaggcgatagtaattttgctatcgagataaacgtcctgcacggcgttaatcagtttcacgccgtcagccatcgatttcttgaacgctttacgtccaagaatcagccccattccgcctgcgcgtttgttgataaccgcagtacgcactgcatcgctgaggtcagtttcaccgcccgcagcaccgccggagtttatcaacccagcccgacccatatagcagttagctaactgataacgcaccagatcaatcgggttttcgctggtcaatttgctgtaaacacgatcgtcggtgtaaccgtaattaattgctttatagccgccgttattttccgccattttttgtttgacgatatctgcaccgatggttgccgccagatggtttgcctgaccggtcaggtcggcggaaacatggtaatcaacgccatctttcttaaaggcggagttacgcaaataggcccacagcactgtcaccatacccagctcgtgcgcacgttcaaaagccgcagaaatttcttcaatctggcgacgtgactcttccgagccaaaatagatagtcgcaccaaccgcaaccgcgcccatgttgaacgcctgctccacgctggcatacagcgtttgatcgtaggtattcgggtaacttagcgtctcgttgtgattaagtttgacgaggaatggaatgcgatgcgcataacgccgcgataccgacgccagcacgccgtaagttgacgccacacagttacagcccgcttcgatcgccagttcaacaatgtttttcgggtcaaagtagagcgggttagcagcaaatgaagctccggcagagtgctcaacgccctggtcaaccggcagaatagaaagatatcctgtgccagccagacgcccggtgttgtacaacgtctgcatattacgtaacaccgctggcgggcgattattgtcaatcattacgcggtctacgtagtcatgtccggggagataaagctggtcagaaggaattgtcatacaacggtgctgtaaaaggttgtcggcgtctttgccaagcaactgcgcaatatctgtcattactatgctcccgtaaattccgattggatatcggctatggattgtcctggcccgccttttgcgggcaatcataatcctggtcgttacgggcgagtttttccatcttttggatgttttttcagcgttttctgttggctcgattcatcagaaaaaatgttagcgcggtcaagttttcaccgcaaaggtatttaaaaggtattattaagtggtattgtcatcgcgtaccttacattacctgtcatgaaggaattaaaagatgaaaacaacagcaaagctgtcgttcatgatgtttgttgaatggtttatctggggcgcgtggtttgtgccattgtggttgtggttaagtaaaagcggttttagtgccggagaaattggctggtcgtatgcctgtaccgccattgcggcgatcctgtcgccaattctggttggctccatcactgaccgctttttctcggcgcaaaaagtgctggcggtattgatgttcgcaggcgcgctgctgatgtatttcgctgcgcaacagaccacttttgccgggttcttcccgttactgctggcctactcgctaacctatatgccgaccattgcgctgactaacagcatcgcttttgccaacgtgccggatgttgagcgtgatttcccgcgcattcgtgtgatgggcactatcggctggattgcctccggtctggcatgtggtttcttgccgcaaatactggggtatgccgatatctcaccgactaacatcccgctgctgattaccgccggaagttctgctctgctcggtgtgtttgcgtttttcctgcccgacacgccaccaaaaagcaccggcaaaatggatattaaagtcatgctcggcctggatgcgctgatcctgctgcgcgataaaaacttcctcgtctttttcttctgttcattcctgtttgcgatgccactagcgttctattacatctttgccaacggttatctgaccgaagttggcatgaaaaacgccaccggctggatgacgctcggccagttctctgaaatcttctttatgctggcattgccgtttttcactaaacgctttggtatcaaaaaggtattattgcttggtctggtcaccgctgcgatccgctatggcttctttatttacggtagtgcggatgaatatttcacctacgcgttactgttcctcggtattttgcttcacggcgtaagttacgatttttactacgttaccgcttacatctatgtcgataaaaaagcccccgtgcatatgcgtaccgctgcgcaggggctgatcacgctctgctgccagggcttcggcagtttgctcggctatcgtcttggcggtgtgatgatggaaaagatgttcgcttatcaggaaccggtaaacggactgactttcaactggtccgggatgtggactttcggcgcggtgatgattgccattatcgccgtgctgttcatgatttttttccgcgaatccgacaacgaaattacggctatcaaggtcgatgatcgcgatattgcgttgacacaaggggaagttaaatgaaaacagaacgtattctcggtgctctttatgggcaggcgttaggggatgcgatggggatgccctccgagctttggccacgcagccgcgttaaagcacactttggctggattgaccgttttcttcctggaccaaaggagaataacgcggcctgttattttaaccgcgccgaattcaccgacgatacctcgatggcgctgtgtctggcggatgcgttactggaacgtgaaggcaagatcgatccggatctgattgggcgtaatattctcgactgggcgctgcgtttcgacgcctttaacaaaaacgtactaggtccgacctcgaagattgcgcttaacgccattcgcgacggtaaacccgttgctgaactggaaaacaacggcgtgaccaacggcgcagcgatgcgcgtctcgccattaggttgtttgcttccggcgcgtgatgttgattcctttattgatgatgtagcgctggcgtccagcccgacccataaatccgatctggcggttgcaggcgcggtagtcatcgcatgggcgatttctcgtgccattgacggagaaagctggtcagcgattgttgattccctgccttcaattgcgcgacatgcacagcaaaaacgcatcactacgttcagcgcctcactggcggcgcggctggagattgcgctgaaaattgtgcgcaatgccgacggcaccgaatccgccagcgaacagctttaccaggtcgttggcgcaggtaccagcactattgagtccgttccgtgcgccattgcgctggttgaactggcacaaaccgacccgaatcgctgcgccgtcctgtgcgctaaccttggcggcgacacagacaccatcggtgctatggcgacggcaatttgcggcgcgttgcatggcgttaacgctatcgatcctgcgttaaaggcggaactggatgcggtaaatcagcttgatttcaaccgctatgccacagcgctggcgaaatatcgtcaacaacgggaggcggtatgagcggcgctcgattacacacgctgctgcctgaattaaccacgcgtcagtcggtgatggtcgtcggcgcggcggtcattgacgtgatcgccgacgcttatgccctcccctggcgtgggtgcgatatcgaactgaaacagcagagcgttaacgttggcggctgcgcactgaatattgccgtggcgttaaagcgcctcggcatcgaagcgggtaatgccttgccgctcggtcagggcgtgtgggcggagatgattcgcaaccggatggcaaaagagggcttaatcagcctgatcgataacgccgaaggtgataacggctggtgtctggcgctggttgagccggatggcgaacgcacttttatgtcattcagcggtgttgaaaatcagtggaatcgccagtggctggcgcgattaaccgttgcgcctggcagcctgctctatttttccggttatcaactggcctcgccctgcggcgaattgttagtggaatggctggaagagctgcaagacgtgacgccgtttatcgattttggcccacgtattggcgatatcccggatgcattactggcgcggatcatggcctgtcgacctttagtgtcgctcaatcgtcaagaggctgagattgccgccgaacgttttgctttatccgcagagataacaacacttggcaagcaatggcaggagaaatttgccgcgccgttgatcgttcgtctcgataaagaaggcgcatggtatttcagcaacgacgcttctggctgcattccggcatttccaacgcaagttgtcgacaccattggggcgggcgacagtcatgccggtggcgtacttgccgggctggcctctggtctgccactggcggatgccgtattactgggcaatgcagtggcgtcgtgggttgtcgggcatcggggcggtgattgtgcgccaacgcgcgaggaactactcctcgcacacaaaaacgtatagatcgctgcgacagtggctaatgctgtactcaataggccgttgctgttggtcaagcgccacttgcttgatcaccagcaccggtattttgctatctaactgaatatgtgactgaaactcggcatccggcatccgggcgctaacgcgggaacgcgtacgttgtgggtaaatgtgctggctgcggaaatagtcataaagtgaaatcccgatggcatcaacatcatgaattaaatgcgccggaacccacgattcctcaatcgataccgcttcttcatcgacatagcgaatacgcttaagcaaaaagacatcacttcctgcttcgaccgccagctgctgcgcgacttcttcgggacatttcacgacacgcttgttaacccatagcgtatcgggctttttcccgcgcaataccacctgctgagaaaaacctcgcgcttctttcaacgagtattcgaagatgttgttgatctgcgtgccgtaaccgcgcgaacgcgtcaccacaccctcttcttccagcgcctgcatcgccttgcgcaccgtaatgcgcgaaacgccggttaactgacttaaatcacgctcaccgggcaaaatattgccatgctccagcaccccgctgcgcacggcattttttaccgtttcggcaaacttaatataaagcggcgtgttatccgccgctaaaatacgctcgttcagttgggcaatcagctgggtatgcgcttgttccatttgtctttttcctgccggggagtctggtgggagtatatcactgcttcttatttaaggcgtttctttaatcccatcaacgaatgcctgcaactcctccaccgtgccattaaatacattaaaatccaccggaccattgatgccatctacctgtccacggtcggaatgctgccagaagcgccaggccattccgtcattgtccggacgacgttgatagtagtgagccacccaccacggatattcattgaaatagcccgccagattggtgtgataaaaaacggctcctgagtaaataatcggctttttccccgtacttttttcgaccatttttagccactgacttacccgcttgcgtaattcttttgccgataattttccccgttcttctacgtccagcacggcagggaaatcgccttgtgagaaatccaccgtttgcagaaataatctcgcctgaactgaagcggataccgacggggagaaataatgatacgccccacgcagcaggccattttcgcggcttagttgccagttacgcgaaaaataggggtccaccagcttttcgccttccgtcgccttaataaaagcaaactgtaagcggataccattgtcgcgcatttttgccacccgctgccagtcgatccgctcctgccagcgcgaaacatctattccgtgaatggtgtaactggcaggaatgcgaatagcgaaagatttaaccgggcgataaccgtagaagtggatgtagtctgtaatctgaactgctgtcgaatagaaaaaattcaccgtctgacgcggataaattgcaacgatggaaattagcccaagagcgcataatagagaggtgagtttttttcgactggtaattcttagctgcattggtttcatccctgaatgtcagtgccaaaggctgacaataaccaaagcagctatagtacggtgctcaccaccaggcgtggaagtggtgaaccggaccaataccgtgaccaacttccagcgtgtcggcctgggctaacgccgatgaaagccagctttttgcctcctgtacggtgtcagcccagtttgtatggcgcgggcgtagtgcagccaacgccgcagagagtgtacaaccagtgccgtgggtgtttttggtcataatgcgcggtgcggtaaaccgttgttcaccctcgcgggtaaacagccagtccgggctttgctcatcatccagatgaccacctttcattagcactgcgccacagcccatcgccaacagcgatcgcccttgttccagcatttcctgttcggtgcgcgcgtgtggcgcgtcgagcaaggcggcagcttcgggcaagtttggcgttattaatgaaacctgtggcaataatcgactgcgcagcgtagcaaccgccgaaggtgaaagcagcgggtcgccgctttttgccagcataacggtgtcgagtaccacgttttggatctgataacgttgcaaccgttctgccaccgcttcaacaatatcggtttccgccagcataccgattttagtggtatcgattcgcacatcgctgaacaccgaatcgagctgggcggcgacaaaatcaggctcaatgcgatacaccgactgtacgccacgggtattttgcgccaccagtgcagtaataactgagcaaccataagcgccaagtgccgagaaggttttaagatcggcctgaatccccgcaccaccactcggatcagtaccggcaatcgtcagagcgttaattcgtttcatgcctgcacctcctgcgtcaattgccagagcgcatcaaggaaatgtggaacaaaactgcctggcccctcgcttctggcgactgcgcgttctccggcttgtttcatccagtgacaggcagatgcgacattttccagcgtatcgcctggtaacgcacagcaggcagcgacaaccgccgataatgcacagccagttcctaccactttggtcattaacggatcaccaccgtgaataccaatgatacgatgtccatcggtaacataatccatctcgccagtgaccacgacgattgcgccagtttcccgtgccagtgtttgtgcagcgggtatcgcgttagctgcggcgtcagtggtatccactccccgtccgccattagcaatgccagctaatgccatgatttccgaagcattaccacgtatcgctgccggtttaaaagataaaagttcatgacaaaaatggcggcgataatcgagcgcacccaccgctactggatcaagcgtccagggtgtttgagagctttttgcttgctcaacggcagcacgcatcgcctgagcgcgtggctgcgtcagtgtgccaacgttaatcaacaaggcactggcgatagccgcaaactgactggcctcttcggtttcgataaccatcgctggcgatgcaccgagcgccagcaaggtattggcggtaaaggtttgcaccacatcattggtcatgcagtgcacaagaggggaatgttggtgaaaaaggtgtaacgcgtgcgcagattgcgctgaacccagcaggtcgacttgcatagtttgctcctgccataacgtgaagaagcaatgacctggtggtccgtgacttccctacgctggcattatccagatcaggtgatacgggtatttctcagccttcacgcagaagggcaccccgagtcgtttggttgcgatgataaatcgcagaggaggatggtaatgtccagcgcacgcgttgtaaacgaggaaaaacggcagttttacaatcgcgttaataaattatttgatatatgaatccagcaccttcagaacgacatccagatcttcttcacgttttagctcatccccctggtgaacgatgtgttccgtcagatgacctttaatcacttcccgcatcagaccgtttaccgcgccacggatagcagcaatctgttgtaaaactgcagcgcattcgtgcggctcgtcgagcattttcttgagcgccacgacctggccctgaatcttactggcacgcgctttcagtttctgtttatcacggattgtatgagacatggcaacacctggttaacaagaatatgaaaaatcatagcactattaatctactggggggtagtatcaggtactgggggggagtagaatcagattgccgaattaatactaagaattattatcatgaccgaatttacaactcttcttcagcaaggaaacgcctggttcttcatccccagcgccatcttacttggtgcgcttcatggcctggaaccagggcactcaaaaacgatgatggcggcgtttatcatcgccatcaaaggcaccattaaacaagcggtgatgctcggactggcagcaactatttcgcataccgcagtggtctggttaattgcctttggcgggatggtgatcagcaagcgctttactgctcaatcagcagaaccgtggctccagctgatttccgcagtgatcattattagcaccgcgttctggatgttctggcgtacctggcgcggcgaacgcaactggctggagaatatgcacgggcatgattatgagcatcatcatcacgatcacgaacatcaccacgaccatggacatcatcaccatcacgaacatggcgagtatcaggatgcccatgcacgagcccatgccaatgacattaaacgacgctttgatggtagagaggtcaccaactggcaaattttgttatttggcttaaccggtggccttatcccctgcccggcagcaattaccgtgctgttgatatgcattcagttgaaagccctgacactgggcgcaacactggtcgtcagtttcagcattggcctggcgttaacgcttgtcaccgtaggcgttggcgcagcaatcagcgttcagcaggtcgcaaaacgctggagcggatttaacactctcgctaaacgcgccccctatttttccagtctgttgattggcttagtcggtgtgtatatgggcgtacatggcttcatgggcataatgcgataactcaatcctttaggcttgcatgttatcttcagcccaggatgattcttaaatcagctatttccgctgactctctgctcgctaaggatgcttttagggcatcctttcatttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgttattttttattattagccacttgctcgtcttgcttgttattagtcgtatttcacgttgattaatgcggttgcctccagtgcgccagatttaactttgtttgtatcgtagacgtagtaactggctgttatcggaattgaaaccgttgtatctgtaagttttgacttcgccgcaacttcctttaaatttgtatatcctttactgctgttagtgatatttaaaagtgtgactggcgaaccattactttcaagaataaatcctacgccattatcttccgcacctttcagtattgtgttgctgttggttaacaagtcagaacttgataaatacacctgcattttccgtgatgtttgattttgttgacctaataaatttttacaacgcagaataatatccccttgtttactatttattgttgctttgttacctgtggctggtaattgtgaaacgggaatactgtctaaagtaattaataaatcgtccggtttgcaggttgtggttatcgggttgtatgacaatgtcagattaaaggaatagacacctgcattttgtgccaatgcatttctgtagctatttacacatgcatcccatgacttgccacctaataaacacagtagaaattgtactgcggcactcccgcgtgtcgatgatgaagcactggataatgtcgcaacaccattaatcatcactgaaccgccgccccccgcagaaacattcacttttgcattactggccgcaggtgtcaccgtaactgaataaccactggtgaaactggtctgattatttgacaacgtgatgttgtttttattggtccattcaaaatgtaaatttaattttatggtatcgttataaagtccaacaataatatccgacgggctcataggggtgatagtatttgtacttacgcatgacgaatcattaaaattatgctcatatgtcgccatttgtgtttgagtaagtgcaaaatccccctgaacaaccaagttgtgctgaacagataactcactataacatgccgcatagctcacaggcataaccatcatcattaatataaatagcattatgcgaatttccatagaaccacctgactattactggcaaatataatttctactttcatcaatctctttaccgaaggtgattgtgcatgaaagtccttgttgcttatcaattgccacattaaccgatggcggtacttcattggtgcgaataaataactgacttccctggccgacaacgccaatattatgaccatggatatcattgacttcataaccaaacgttaatgattgcccatctgctcttaacgcttttataaaccatggcttgcgctgatcggtatcaaaattaaccagtacaaccgcgccgcgataaggggcggcaattttccggttgccacgtaattctgcttcgctatcgctttgcgacacatccagcatcaggtgattttcccgataaggtgtcattccgtcgtatatcaccactccattacggtttgttgtgcgatatttttgcccattgacataagcatctttaattcctggcgcattcatcacagcaaacgtttcggaaagacggttcgccagattaacgccacccgaccaggcgacaatgccccctgaaacactggctccagcctgtcgataagtactcgactgactataactgccattcactgtcgcaaccggcgcgttccaggtcaaattcgccccagctgtcgtttcatttccctgatgttgatgactcaggttgacaccataattgaactgatcccgactccctactgttcctgataatcccgtattatttgaggcaaacccctgatcatcaaacgtcgttgagttagacatatatatttgccgacgaggcgtcgaaacgtcatcaccccaatcaaagggaatcgatataaaaatattaaaacgtttctcttcatgatgattctcgtcataagcctggcttgccgcgagggtatagcttatccgtcgcaggttgttggaataactcaactgataatccttactactgccgctacgcccccagtaatctcgccataacgtacttaatgacacagacccccaaccttctggcaatgactggctcatattggcggaaaagctatttttgcggccaaaatcgttctggtaataatcggcaatgtcatagacatcgttttcatcacggcgataattatctttattgtttgcccaaacgtgatcgttaaatgtccggtaatcacgcgacgaataacgccaggccgccagaccaaaacgcgtcgacgtttggctcacaaatttgttgtaggcaatttgataactttgcccgtcaaacacatcgccgttgtcttgtttactatgcgacttagtggcatcgacggaaatggcaccaatgcgtgtattccagccagcccccaaagtaaacgcgtaataattattcgcgaccatcgagccaccatacagcgtcaataaattattaaaaccatactgataacccgcctggacaaaatcactttgtttgctcgccccttcaatatggctacgacccgccgctaaatcatatttcgacacgccgggttgcagcatatttggcaccgctgcataaggcaccagataggtggttaccgagccgtccgcctctttcacgctgacatcaagatctgctccaccaccggccaactgcaaatctgtaatcgcgaacgggccaggaggaacctctttctgataaaccacaaaaccattctgttcaatagttaccagcgcgttactctgagcaatcccctgcacccgtggcgtaaaattttgtttcgagttaggcaacatctgcatatcacgaaacaaccgcacacctctgaagcgaacagaatcaaaaatatcgcttgatgtgtacatatcacccacgcgaagcgtgccgagaagttgggcaaatccacgttccagatacagggtattgcttttccacacccctggattgttatttgttttactgaaactggcatcagaatgcagttgccaccccagtaaatttaacccgctgttaaaacgtacatatgtactcttgttattacccgacgctttatagtcgctgtaatactgactcagataataagaggtataaaacgcattaataccccgctcccagttttccggtggaacatagccactttccagttcttccacccaggcctgcgggacactgaaatcgagacgaaaaaccccgatatcccaggtatagctcccaccctgaacaagttgctcaaatgttaaacattgcttaccgctggcgaagttatcgctattaatgcctaaccgcttgataacttctcttgataaacatgtttcttgcgggttgtctttaacaataatctcatatttcccgcgccattgcttattgacataaatatcgatgtcatactgccccggtaagggttgattatcatcaagacgaatatttgcaacctgctggtctttcattccacctatcataaaatgggtatcaaaggtttcttcagctgcataagcttcaatgccgagcaataacgctacgattgctgatgcaagtggggtcattctcaacataggcagctcctgcaattaaattttgtcactaatatagttgccatggtcatcgataatggtcagatgccagttatttgcattattacttttgacattaacactctgactttctaagggggcaatcataatagtttcataattgactttgacattattagctttgacatccgaaatcgtcacccaattagctgagtcattttttatcaccaaaccattgccactgcgatttaccagcaattttttaaatgtcgctttatttaccggagcaatacccgctggccggtaaaacaacttaattctgttttgcatcgcaaacttcagtgcattcttaccttcttgctctggactatttggtggaatatccagaacattcagataaaaaatgctttctttattagtgggcagtttattcggcataattttgatttttacttgctgcccggaatttgcccctatttttgccactggtggcgttaacatgaaaggaacctgaattttttctggtggtaatgacgtatcgccatcatcaatccacgcctgcagcagcgaagaacggtttccctggttcatcaactgcaccatcacttctttattttctgccgggtaaataatgcgcgtcccgtagataacaattccggcatgtgcaggaaggaccatagaaaaaatgagtaaagataataatcctttcattttaatgcctcttaaattaaaaggccgccatgggatagcggccatgtttattacctggagaaacttacaattttatttattaatcctgcgccacacgcataaccagagaagataacacatcacctgattgcactgagttatctgtcagtttcaggtattttgctttaaacggaatagcatattgaccttccgctgttttataactctcaatgttaaaaggtgcagaaacatccaggacatcgctgttatcacctaaatagagatagtaacccacggtatcgttgctactggctatcgccttatcgttaccggttattttatcgttggtaatcaacgagagttttacaccagcaacttctttcgggcagctaatttttaacatgctgctggttacaccgactgcatcatcataggtagaatatttagctttaccttcaaagacactggttggtacagtcggcatattaatacttactgaatcaccacccgcttcgaatttacacggagattctgcaatattccccttaatagttaatgttccggtatcaacgtctgcagcaaatactccagcgctcataaaaaaagaagaaaagacagcggcagcaataattgaacgtttcataatatgttccttaataaaatttatttttggttgttaagagtctgtatctcttggaaacaaatttctcacatcaaaaaagttgccgcaatgtaaacacattgttttattgatttaaaacaaattaaccattgcaatataaatacaaaaaatatttaagagtattaactatttatcgcatctatcaattaatgtagatttatgtaaatggtattgttgatatcaataaaaaagccgaaatcatttatataaatgatttcggctttctaaatgcaattaaaatcaggttgccaaattaatcgtagcgatttaacacgattcgacgtttgctatcgctacctgcaacaaccacttctgtcgttacacctttgacgggcgaagaaaacagatgacgggtgtcaacattatacgttaactgaccacaatgctgttgaggttgaccattaaccatagccatactgcatgttgggggactgatcctgccattaatcgctaatgtggcagtctctgaagagaatgcgggagaagccaatccataggcaagaaaaataattcctgacagccaatacttattcattgaacgttatccctgtagtaaaggttatgcctggatagaatgagtgcataacaaactatagctgtacatccactacacagccacgaaggatgataatgaagcattgcctgtatgatcaatcgactttgtagagtttcggacgaaggtccgcagaatattcgcagtattaaataagtgttcattaatgcggcaaaaactaatacaccgcatcaatgtaacatctctgcggtgtatgaagaataaccagaatggttaataggcgttagaccgcgcggaaggaaatctcgcctggaatgacttcaccctgccagtagagctgagctgcaacgcggtcagccagctggcggtagatagcggtaaattcgctctccggacggctgataaccgttggcgtacctttatcgagatcctcacgtaaggagatgtgtaacggcatctgccccagcagctgtgtatggtatttttcagccagtttctctgcaccaccggtaccgaaaatcggttcatggtgaccacagttactgcaaatatgcacactcatgttctcgacaataccgagcaccggaacctcgactttctcgaacatcacaatgccttttttcgcatcgatcagcgcgatgtcctgcggggtggtgaccacgactgcaccggttactggaatgttttgcgccagcgtcaattgaatgtcaccggtgcctggcggcatatcaagcaccagatagtcgagatccggccacaaggtttcctgcaacatctgcattaacgccttgctcgccatcggtccacgccacaccatcgcattgtcgtcagtgaccagataaccaattgaattggttgccaggccatgagacataatcggtgccatatgggtaccgtccggcgaagttggacgctgattttctgcgcccaacattgttgggattgatgggccgtagatatcggcgtccagaatgccgactttcgccccttctgccgccagcgccagtgccaggtttaccgccgtggacgatttacccacgccgcctttaccggaactcaccgcgataatgttcttcacaccgttaattcccggctgattcttcacgcgtttcagagtggctatgttatgcgacagtttccagtcgatagctttcgccccggtgatgcgcagcagttcggcgctacattgctcttttaactcttcgaacgcgctatgccagacaaacggcataaccagttccacatgcaacgtgtcgtccatccaggcgacatggtgcaacgctttcagcgtggtgaggttatgcttcagggttgggtgctgaaaattggccagtgtcccggcgaccattgcgcgcaaggcttctggtgatttggcctgggattgttcgttcatcccgactccttttttgtatagataaaccatcagctgatagtttacctgaagaatatagagaagtacttacttaacattttcccatttggtactatctaaccccttttcactattaagaagtaatgcctactatgactcaagtcgcgaagaaaattctggtgacgtgcgcactgccgtacgctaacggctcaatccacctcggccatatgctggagcacatccaggctgatgtctgggtccgttaccagcgaatgcgcggccacgaggtcaacttcatctgcgccgacgatgcccacggtacaccgatcatgctgaaagctcagcagcttggtatcaccccggagcagatgattggcgaaatgagtcaggagcatcagactgatttcgcaggctttaacatcagctatgacaactatcactcgacgcacagcgaagagaaccgccagttgtcagaacttatctactctcgcctgaaagaaaacggttttattaaaaaccgcaccatctctcagctgtacgatccggaaaaaggcatgttcctgccggaccgttttgtgaaaggcacctgcccgaaatgtaaatccccggatcaatacggcgataactgcgaagtctgcggcgcgacctacagcccgactgaactgatcgagccgaaatcggtggtttctggcgctacgccggtaatgcgtgattctgaacacttcttctttgatctgccctctttcagcgaaatgttgcaggcatggacccgcagcggtgcgttgcaggagcaggtggcaaataaaatgcaggagtggtttgaatctggcctgcaacagtgggatatctcccgcgacgccccttacttcggttttgaaattccgaacgcgccgggcaaatatttctacgtctggctggacgcaccgattggctacatgggttctttcaagaatctgtgcgacaagcgcggcgacagcgtaagcttcgatgaatactggaagaaagactccaccgccgagctgtaccacttcatcggtaaagatattgtttacttccacagcctgttctggcctgccatgctggaaggcagcaacttccgcaagccgtccaacctgtttgttcatggctatgtgacggtgaacggcgcaaagatgtccaagtctcgcggcacctttattaaagccagcacctggctgaatcattttgacgcagacagcctgcgttactactacactgcgaaactctcttcgcgcattgatgatatcgatctcaacctggaagatttcgttcagcgtgtgaatgccgatatcgttaacaaagtggttaacctggcctcccgtaatgcgggctttatcaacaagcgttttgacggcgtgctggcaagcgaactggctgacccgcagttgtacaaaaccttcactgatgccgctgaagtgattggtgaagcgtgggaaagccgtgaatttggtaaagccgtgcgcgaaatcatggcgctggctgatctggctaaccgctatgtcgatgaacaggctccgtgggtggtggcgaaacaggaaggccgcgatgccgacctgcaggcaatttgctcaatgggcatcaacctgttccgcgtgctgatgacttacctgaagccggtactgccgaaactgaccgagcgtgcagaagcattcctcaatacggaactgacctgggatggtatccagcaaccgctgctgggccacaaagtgaatccgttcaaggcgctgtataaccgcatcgatatgaggcaggttgaagcactggtggaagcctctaaagaagaagtaaaagccgctgccgcgccggtaactggcccgctggcagatgatccgattcaggaaaccatcacctttgacgacttcgctaaagttgacctgcgcgtggcgctgattgaaaacgcagagtttgttgaaggttctgacaaactgctgcgcctgacgctggatctcggcggtgaaaaacgcaatgtcttctccggtattcgttctgcttacccggatccgcaggcactgattggtcgtcacaccattatggtggctaacctggcaccacgtaaaatgcgcttcggtatctctgaaggcatggtgatggctgccggtcctggcgggaaagatattttcctgctaagcccggatgccggtgctaaaccgggtcatcaggtgaaataatcccccttcaaggcgctgcatcgacagcgccttttctttataaattcctaaagttgttttcttgcgattttgtctctctctaacccgcataaatactggtagcatctgcattcaactggataaaattacagggatgcagaatgagacactttatctatcaggacgaaaaatcacataaattcagggcagttgagcaacagggaaacgagttgcatatcagttggggaaaagttggcaccaaagggcaaagccagataaaaagtttttcagatgctgcggcagcggcaaaagcggagcttaagctgattgcggagaaggtgaagaaggggtatgtggagcaagcgaaggataattctttgcaaccttcccaaacggtaacgggctctctcaaggtagcggacttatccaccattattcaggaacaaccctctttcgtagcagaaacccgtgcgcctgacaaaaatacagatgctgttttaccgtggctggcgaaagatattgctgtcgtttttccgcccgaagttgtacacaccacgttaagtcatcgccgctttcccggagttcctgttcagcaagcagacaaattgccccaattacgtcgcttagcctgtagtgtgtcgcaacgggataataaaacagccacatttgacttcagcgcctgttctttagaatggcaaaacaccgtcgcccaggcgatcagtcagatcgacggcctgaaaacaacacagttaccatcaccagtaatggctgtactcacggcacttgaaatgaaatgcacaagatataaagtgcgtgaggatgttatggatcagatcgtccaggaaggcggtctggaatatgctactgatgtaataatacaccttcaacagattgatattgaatgggattatgcgaataatgtcattattattctgccgtctggcattgcacctagctacttggagcaatattccagatttgaatgacgcctacgtaaacatttatcactgacggaagagtctctctggcaaaaatgtgcacaaaaacttattgccgcaattccacatattccagaatggcggcaaccattaattgctttgttattacccgaaaaaccagaaattgcacatgaaattgcccagcgtctactggggcaaaaaaaattaccctcgcttgagtggttaaaaatagtggcgactgatgagcacattcttgcctcattagaaaaatatcacgaaccatatgccatttttgatgattactattgtggtgcgatatggtcagccaccgtattacaggagcaaggtgttgcagccctgccccgatttgctccctatgccgcaagtgactactgcgccgatgtgttgcgtcatatcaatcatccgttcgcattgacactgcttatacgtgtagccgggcaaactaaacgctgtcacgatcggatgacgaaagccattgctgcgttcccacatgcagcaatggcggcactgacggaacttcttgggcaaaaagaagagaacagttggcgcattatgctaatgacaatgcttatctcacaaccagcactggcagaacaggtcattccctggctctcgacacccgcagttgccgtactgaaatcatgccagcaacaactgacacagccctcaaaccatgccagcgccgatctactgccagccgtagtagtctcccctccctggctttcgaaaaagaaaaaatcgccgattccggtgctggatttagcgccattaggcattgagccaatctgttatctgacagaagaaatcagtaatcaacttttggcgaaatatatctggtattcaaaacacatcacggttagccatgaagaaagtactaccaacctgttggcaaggatgggttttcaacgacggatcgctggtacatatattaaagctcccgaagcggtagttgaggcatggctaaatgaagattattcaaccttactaagtgaatttaaggtgtttcattcacctaccgggcattattggcagttggggattttgacaacattgccgctggagaaagcagtaaaagcatggaatgcccttaccctatctccacataccgataccgaatactccatgttacattttggactcaaagggttacctgggttagtaaactcacttgcacgctatccacaagaagccttgcccatcacgaattacttcgcagcgagtgagctggctcctgccgtcgcccgtgccttcaacaaactgaaaacgctacgcgaaaacgcccgtagctggctgttgaaatacccggaacatgcccttaccggcctgctgcctgcggcgctcggcaaagccggtgaagcacaggataacgcccgcgctgccttgcgtatgcttaccgaaaacggtcatcagccattactgcaagaaatcgcccgacgttataaccagccggaagtaaccgatgcggtgaacgctctgcttgcgctcgatcccttagataatcacccgacaaaaatccccactcttccggccttttatcagccatcgctctggacgcgcccggtattaaaagcaaatgcccaatcactgccagatagcgccctcctccacctcggtgaaatgctccgcttccctcaggaagaggctctgtatccgggattattgcaggtgaaagacgtctgttccgccgactcactggcgggatttgcctgggatctgtttaccgcctggcagaccgctggcgcgccgtcgaaagagagttgggcgttcactgcgttaggcgttctcggtaacgatgacaccgcccgcaaactgacgccattaatacgcgcctggcctggtgaatcccagcataaacgcgccaccgttgggttggatattctcgctgctatcggtagtgatatcgcccttatgcagcttaacggcatcgcccagaaactgaaattcaaagcattacaggagcgggcaaaagaaaaaattgccgacattgccgagagccgcgaactcacggtggcggagcttgaagatcgggttagcaccggatctcggtctggatgataacggttcgctgctgctggattttggcccacggcagttcaccgtcagctttgatgaaaccttaaaaccgtttgtgcgtgatgtttccggcagccgcctgaaagacctgcccaaaccgaacaaaagcgatgatgaaacgcgggcgaacgatgcggttaaccgctacaaattgctgaaaaaagatgcgcgtaccatcgccgcccagcaggtagcaaggctggaatccgccatgtgcctgcgccgccgctggtcgctggaaaacttccagctcttcctggttgagcatccgctggttcgtcacttaacccgccgtctgatttggggcgtttatagcgccgaaaaccagctactggcttgctttcgcgtagcagaagataacagctccagcaccgctgacgatgatcttttcaccctgccggaaggcgatatctctatcggcactcctcacgttctggaaatatcaccaacggatgctgccgcctttggtcagctttttgccgactacgaactgctaccaccgttccgccagctcgaccgtaacagctacgccctgacagaagccgagcgcaatgccagtgaactgacccgctgggcaggcagaaaatgcccgagtggtcgggtcatggggctggcgaataaaggctggataaagggcgaaccacaggatggaggctggatcggatggatgatcaaacctttgggtcgctggtcgttaatcatggaaatcgatgaaggctttgcggtaggcatgtcgccagccgaactcagcgctgagcagctcttaagcaagctgtggctatgggaaggcaaagcagaaagatatggctgggggagtaattcaacacaggaagcgcagttctccgtaatcgatgccatcaccgccagcgagctaattaacgatattgaagccctgtttgaataaggaaagagcatggacaaggaattaccgtggctggcggataacgcccaactggaactgaaatataaaaaaggcaaaacgccgctcagtcatcgtcgctggccgggcgaaccagtgtccgttatcactggaagtctcatccagacattgggtgatgaattgctacaaaaagctgagaagaaaaaaaacattgtctggcgttatgagaatttttcactggagtggcagtccgccatcacgcaggccatcaacttgatcggcgaacacaaaccctcaatcccggcccggacaatggcggcgctagcctgtatcgcgcaaaatgacagccaacagttgctcgacgaaatcgtccaacaagaggggctggaatatgcgactgaggtggtgattgcacgccagtttattgcgcggtgttatgagagtgatcctctggtagtgacattgcagtatcaggacgaggattatggctatggttatcgctcagaaacctataacgaattcgatctccgactgcgtaagcatctctctctggcagaggaaagctgctggcagcgttgcgccgacaaactcattgccgcactaccaggaataaacaaagttcgccgcccttttattgcgctgatcctcccggaaaaaccagaaatagccaatgagttggtaggccttgaatgcccgcgaactcattttcattctaaggagtggttaaaagttgttgctaatgaccccacagcggtgagaaaactcgaacactactggagccaggatatatttagcgatcgagaagccagctacatgtcgcatgaaaaccacttcggctacgcggcctgcgccgcccttttgcgcgaacaaggactggcagccattccgcgcctcgcgatgtatgcccataaagaagattgcggcagtctgctggtacaaattaaccatccgcaagtcatccgcaccttgctactggtggctgataaaaacaaacccagcctgcaacgtgtagctaaataccataaaaacttcccccatgcgacgctcgccgcactggcagaactgctggcgttaacagaaccaccagcccgccctggttatccaatcatcgaagacaaaaagctgcctgcacagcaaaaagcacgcgatgaatactggcgtacgctgttacaaacgctgatggcatcgcagccacaactggcagcagaagtgatgccgtggttaagtactcaaccccagtcagtgctgaagagttatttatcggcaccgcccaaaccggttattgatggcaccgataacagcaatctgccagaaatcctcgtttcaccaccgtggcgtagtaagaaaaaaatgacagctccacgtcttgatttggcaccgctcgaattaactccgcaagtttactggcaaccaggcgaacaagagaggcttgccgccactgagcctgcccgttatttcagcacggaatctcttgcgcaacgcatggaacaaaaaagtggacgagttgtattacaggaactgggttttggggatgatgtatggctgtttctgaattatatactccccggaaaactggatgctgcacgcaattcactctttgttcagtggcattactaccaggggcgggttgaagagatcctgaatggctggaactccccggaagcacaattagcagaacaggcgctccgcagcggtcacatagaagcgttaattaacatatgggaaaatgacaactactcacattatcgtccggaaaagagtgtctggaacctgtatttattggcacagttgccgcgtgagatggctttgaccttctggctgcgtatcaatgagaaaaagcatctgttcgcgggtgaggactattttctcagtatcctcggattggatgcgctaccaggtctgctgttggctttttcacatcgtccaaaagaaacatttccgttaattttaaattttggcgcaacagaactggcgctgcctgttgcccacgtctggcgacgtttcgcggcgcagcgtgatctggctcgccagtggattttacaatggccggaacatacggctagtgcacttatccctcttgtctttaccaaacccagcgataatagcgaagccgcattacttgccctgcgtttactgtacgaacagggacatggcgaattgctacaaaccgtggcaaaccgctggcagcgtacagatgtatggtctgccctggagcagttgcttaaacagggtccaatggacatttacccggcacgcattccaaaagcccctgatttctggcatccgcaaatgtggtccaggccgcgccttatcactaataatcaaactgttaccaatgacgctctggaaattatcggcgaaatgctgcgctttacccaggggggacgtttttatagcgggctggaacaactgaaaacgttctgccagccacaaacgctggcagcttttgcctgggatctcttcactgcgtggcaacaagctggtgcccccgcaaaagacaactgggcatttctggcgttaagtctctttggtgacgaaagcacggcacgggatctgacgacacagatcctcgcctggccacaagaaggcaaatctgcccgtgctgtcagcggcctgaacatccttaccctgatgaataatgatatggcgctgatacagctgcatcatatatcgcaacgggctaaatcccgccccttacgtgataacgcggcggaatttcttcaggtggtcgcagaaaatcgcgggctaagccaggaagagctagcggacagattagtcccaaccctgggccttgatgatccgcaggcgttgagttttgattttggtccccggcagtttaccgttcgcttcgatgaaaatctcaacccggttatctttgatcagcaaaacgttcgccagaaaagcgttccccgtttgcgcgccgatgacgatcaactgaaagcgcccgaggcactggcccgactaaaagggctaaaaaaagatgctactcaggtgagcaaaaacctgctcccgcgtcttgaaacggccctacgtaccacccgacgctggtcgctggcagattttcattctctgtttgttaatcatccctttacccgtctggttacccagcgattaatatggggggtttatccggcaaatgaaccgcgttgtttactcaaagcctttcgtgtggccgcagagggggagttctgcaatgcgcaagatgagccaattgacctgcctgcggacgctctgattggcattgcccacccgttagaaatgacagcagaaatgcgcagtgaatttgcacagctttttgccgattacgaaattatgccgccttttcgccagttgtcgcgccgcacggtgctgctcacacctgacgagtcaaccagtaacagcctgactcgctgggaaggtaaatccgctaccgttgggcaacttatgggaatgcgatacaaaggctgggagtcaggctatgaggacgcatttgtctataacctgggtgagtaccggctggtccttaagttttcacccggttttaaccactacaatgttgatagcaaagcgctaatgagcttccgttctcttcgagtgtaccgtgacaataaatccgtcacttttgccgaacttgatgtgtttgatttgagtgaggcgttaagcgcacctgacgtcattttccattaaaacacagcgggcagtgatgcaactgcccgttatcaacacgacttaccagcggggaaagcgatgatcgtgcaaaaagagctggttgctatttacgattatgaggtccctgtacctgaagatccgttttccttcagacttgagatccataaatgctctgaattatttacaggttccgtctatcgactggagcgattccggctacgtccaacatttcatcaacgtgatcgagaagatgctgacccgctaataaatgatgcgttgatttatataagagatgagtgtattgatgagcggaaattacgaggtgaatcacctgaaactgtaatagcaatttttaatcgtgaactacagaatatattcaaccaagaaatagaataatatactctaaataattcaaattggtccgatccggcgcaacgtcccaatggcctggattataaatctcattatcttaattgcaacggggtccagccgtggttataattcgttcgttggaacacgatgttgcacaggctgtggtgttaggcctgaaaatagtaaataaaagaacctgcctcaccagcaggtttttttatttactgtgatctgctttccagatatttttcgctcaaacaactaatgcgccaaacatttattgcgcgtaaaatatcgtttatttcattaatacatttcagggatgaatatatgtcaccgcagaataatcatctgcagcgtccgcctgctgctgtgttatacgccgatgaactggcaaaattaaaacaaaatgataacgcaccttgcccgcccggttggcagttaagtttgcctgcggcccgtgcttttatccttggcgacgaagcgcaaaatatcagccgtaaagtggtgattagcccctccgctgtcgaacgtatgttagtcactcttgctaccggccgcggtttgatgttggtgggggaaccgggtaccgcaaaatctcttctttctgaattactggcaaccgctattagcggcgatgccgggttaaccatccagggcggggcatctaccaccgaagatcaaatcaagtatggctggaactacgccctgcttatcaatcatggtccgtcaacggaagcgctggtccctgccccgctttatcagggaatgcgcgacggcaaaatcgtccgtttcgaagagataacgcgtacaccgctggaagtgcaggactgtctgttaggtatgctttctgacagggtgatgacggggccggaactcactggtgaagccagtcagctctatgcgcgagaaggctttaatattattgccactgccaatacccgcgatcgcggcgtcaatgaaatgagtgctgcgctaaagcgtcgcttcgattttgaaacggtttttccgattatggatttcgcccaggagttggaactggtcgccagtgcttcggcgcgtttgctggcccatagcggtattccgcataaagtgcctgacgcggtactggaattactggtccgcaccttccgcgatctgcgtgccaacggcgaaaagaaaacgtcaatggatacactgacagcgattatgtccaccgctgaagccgtgaacgtggcccatgctgtgggcgtccgcgcctggtttttagcgaatcgcgcgggggagcctgccgacctggtggaatgtattgccggaaccatcgtcaaagataacgaagaagatcgcgcgcgtctgcgccgttacttcgaacagcgtgtcgccacacataaagaagctcactggcaggcttattatcaagcccgccaccgcctgccgtgaggaaagatgcatgagcgagccgttaattgtcggcatccggcatcatagtccggcctgcgcccggctggtgaaatcgttaatcgaaagccagcggccacgatacgtgttgattgaaggcccggctgattttaatgaccgggtagacgaactgtttttagcccaccagcttccggtagctatttacagttattgccagtatcaggacggtgcagcccccgggcgtggtgcctggacgccatttgctgaattttcgccggagtggcaggcgctacaagccgcacgtcgcattcaggcacaaacttacttcatcgatttgccttgctgggcgcagagtgaagaagaggacgattcgcctgatacgcaagatgaaagccaggccttactgctgcgtgccacccgcatggataacagcgataccctgtgggatcacttgttcgaagatgaaagccagcaaactgcattaccctctgcgctggcgcactattttgcccaactgcggggcgacgcctccggcgatgcgctcaatcgtcagcgcgaagcctttatggcccgctggattggatgggcgatgcagcaaaataatggcgacgtgttagttgtctgcggtggctggcacgctccggcactggcaaagatgtggcgcgaatgccctcagaaaattaacaagccagaattgccctcgctggcagatgccgttacaggttgttatctcacaccctacagtgaaaagcgccttgatgtgctggcaggatacctttcaggaatgcctgccccggtatggcaaaactggtgctggcagtggggcttgcagaaggccggtgaacaactgctaaaaactatccttacccgtttgcgccagcacaaattgcccgcttctaccgcggatatggctgccgctcatctgcatgcgatggcgctggcacagttgcgcggtcatacactaccgttacgcactgactggctggatgccatagcaggctcgctgattaaagaagccctgaacgcgccgttgccgtggagctatcgcggcgttattcatcccgataccgatccgattctgctaacgttgatagacacattagcgggtgacggattcggtaaacttgccccttctacgccacaaccgcctctgccaaaagatgtcacctgcgaactggaacgtaccgcaatctcccttccggcggagcttaccttaaatcgctttacccccgatgggctggcgcaaagtcaggtgttacatcggctggcaatactggagatccctgggattgtacgccagcagggaagtacactgacacttgcaggcaacggtgaagaacgctggaaattaacccgcccgcttagccagcatgcggcattgattgaggccgcctgttttggtgccacactccaggaagccgcacgcaataaattagaagccgatatgctggacgcgggcggaatcggcagtatcaccacatgtcttagccaggcggcgttagcgggtctggcgtccttcagtcaacaattactggagcaactcacactattaatcgcccaggaaaatcaatttgccgaaatgggccaggcgctggaagtgctttatgccttatggcggctggatgaaattagcggtatgcaaggcgcgcagatattacaaacgacgttatgcgcgactatcgatcgcacgctgtggctgtgtgaatctaacggcagaccggatgaaaaggagtttcacgctcacctgcatagctggcaagcgctttgccatattctgcgcgatctacatagcggcgttaatttacccggcgtttctctttctgcggcggtagccttactggagcgacgcagtcaggcaattcatgccccggcgctggatcgcggcgcggctcttggcgcactaatgcgtctggaacatcccaacgccagtgccgaagcggcgctgacgatgctggcgcagttatccccggcacaatctggtgaggcgctgcacggtttgctggcgctggcccgccatcaactggcctgtcagccggcatttatcgccggtttcagcagtcatttaaatcaactgagtgaagccgattttattaacgccctgcccgatttacgcgcggcgatggcctggctaccaccacgagaacgcgggacgctggcgcatcaggtgcttgagcattatcaactggcgcaacttcccgtttcggcgctgcaaatgccgttgcattgtccaccacaggccattgcacatcatcaacaactcgaacagcaggcactggcatcgctgcaaaactggggagttttccatgtctgaactgaacgatcttctgaccacccgtgagctacaacgctggcgattaattcttggcgaagcggcagaaacgacgctttgtgggctggatgacaacgcccggcagatagaccacgcgctggagtggctgtatgggcgcgatcctgaacggctccagcgtggtgaacgttccggtggattaggtggctcaaatctcaccacccctgagtggatcaacagtattcacacgctgtttccgcagcaggtgattgagcggctggaaagcgatgccgtgctgcgctacggcattgaagatgtggtgacgaatctcgacgtgctggaacgtatgcagccttctgaaagcctgctacgcgctgttttgcacaccaaacatctgatgaaccccgaagtactggctgccgcccgccggatagtgtgccaggttgttgaagaaattatggctcgactggcaaaggaagttcgtcaggctttttctggtgtccgcgatcgccgtcgccgttcatttattccactggcgcgaaactttgatttcaaaagtactctgcgcgccaacctgcaacactggcacccgcaacacggcaagttgtatatcgaatccccccgctttaacagccgcattaaacgccaaagcgaacaatggcaactggtcttactggttgatcaaagcggatcgatggtcgattcggtgatccactctgcggtgatggcggcctgtttgtggcagttacccggcattcgtacccatctggtggcgtttgacacaagcgtcgttgatctcacggcagacgttgccgatccggtagagttattaatgaaagtacagttgggcggcgggaccaatatcgccagtgccgtggagtatggtcggcaacttattgaacaaccagcgaaaagcgtcattatcctcgtgagcgatttttacgaagggggttcatcatcattactgacgcatcaggtgaaaaagtgtgtccagagcggcatcaaagtgctgggactggcagcgctcgatagcaccgcaacaccttgctatgaccgcgatacggcccaggcgctggttaatgtcggcgcacaaatagccgccatgacgccgggcgagctggcatcatggcttgcggagaatcttcagtcatgaattcactacgtccggaattattagaactgacaccgcaggccctgacggcgttaagcaatgccggttttgttaagcgcagtcttaaggaactggaaaatggcaacgtcccggagatcagccatgagaacgacgctttaatcgccaccttcagtgacggtgtccgtacccagctggcgaacggccaggcactgaaagaggctcagtgcagttgcggggccaacggtatgtgccgtcatcgcgtgatgctggtgttaagttatcaacgactttgtgccaccactcagtctacggaaaaagaagaagagtgggatccggcaatctggctggaagaactggctacccttcccgatgctacccgcaaacgcgcacaggcgctggtcgctaaaggcatcaccattgagttgttctgtgcgccgggtgaaattccctctgcccgcttaccgatgagcgatgtgcgtttttattcccgcagcagtattcgtttcgcccgttgtgattgtattgaaggcacactttgcgaacatgtcgtactggcggtacaggccttcgtcgaggccaaagcgcagcaagcagaatttaaccatttaatctggcagatgcgcagcgaacacgtcacatcatctgacgatccgtttgccagcgaagaaggcaacgcgtgtcgtcaatatgttcagcaattaagccagacattatggcttggcggcatcagccagccgctcatccattacgaggcagcattcaaccgcgcattgcaggcggcagagacctgcaactggcgctgggtgagtgaatcgctacggcaactgcgcgccagcgttgatgccttccacgcccgcgccagccactataatgccggagaatgcttacatcagcttgcggcattaaacagtcgattaaattgcgcacaagagatggcccggcgcgacagtattggtgaagttcctcctgtgccgtggcgcacggtcgttggctctggcattgccggagaagcaaagcttgatcatctgcggctggtgtctttaggtatgcgttgctggcaggatattgagcattatggtttacgcatctggtttaccgatcccgacaccggcagtattttgcacctttcgcgcagttggccgcgaagtgaacaggaaaactcaccggcagctacgcgtcggctgtttagttttcaggctggcgcactggcgggcgggcaaattgtttcacaagcagcaaaacgcagtgccgatggcgagctgctgttagctacccgcaaccgcttaagcagcgttgtgccgctgtcgcctgatgcctggcaaatgttgagcgcgccgttacgccagccgggcattgtggctttgcgggaatatttacgccagcgtccccccgcctgcatacggcctcttaatcaggtcgataacttatttattctgccggtcgctgagtgtatttcgctcggttgggacagcagccgccagacgctggatgcgcaggtcattagcggcgaaggggaagataatgtgctgacgttatcattaccagcctcagccagcgcaccttatgccgttgaacgcatggcggcgcttttgcaacaaacagacgaccccgtgtgtctggtttctggctttgtcagttttgttgaagggcaattgacactggaaccacgggtgatgatgacaaaaacccgtgcctgggcgctggacgcagaaactacgcctgtggcaccgctaccttctgccagcgttttgcctgtgccgtctactgctcatcagttgctgatacgctgccaggcgttacttattcaactgctccataacggctggcgctatcaggaacagagtgctattggtcaggcatagttgctggcgaatgacctcaccgcggtgggtttttatcggctggcacatgtgttgggacaatttcgtaatacagaaagcgaggcacgggtagaagcaatgaataacggtgttttgctttgcgaacaattattccccatgcttcagcaacaaggatgaaatagtgctttttactaagagttctactccagttccggactgctcacgccacggtattaggcatatcctatatagcccctggtgagagtcaccagttccttgattaaataaaatggagttttacatgaaggctttcaataagctgttttccctcgttgttgcatctgttctggttttctctcttgctggctgcggtgacaaagaagaatcgaagaaattcagcgccaatctgaacggcactgaaattgccattacctatgtctacaaaggtgacaaggtgcttaagcaatcttctgaaaccaaaattcaatttgcctccattggtgcaaccaccaaagaagatgctgccaagacacttgagccgttaagcgccaaatacaaaaacatcgcgggtgttgaagaaaaattaacctataccgatacctacgcgcaggaaaacgtgactatcgatatggaaaaagtggattttaaagccctgcagggtatttcaggaatcaacgtttctgctgaagatgccaaaaaaggtatcactatggcgcaaatggaactggtgatgaaagccgctggttttaaagaagtgaaataatcggttggcggtcatgctctaaacatgaccgccaattttttagccttttttcacatgctggcgcgctgccagtccacgcagaaaataacgtaaaaattgatcgccgcattcgcggaagtttttatgatccggtgcgcgcatcatcgctgtaatttccggcatcgaaacgcggaactgctgttcggtgaggatagccagaatgtcatcggttttcagcgaaaacgcgatgcgtaattttttcagcacgatgttgttattaatgcgacgttccggctccagtgccggagcagactcatccttgccgcgtttttcataaatcaggccattgaggaatgacgacaaaacaatgtccggacaacgctgaaaaccctcttcgtcttctttacgtagccagacggcgatctgttccgcggtggcttcgacattacccagcgccagaatacgcaccaggtcattattattggctttcaaaatgtagcgcacgctgcgcagaatatcgttacttagcatgaggccttcaggtgttgatgaggcaaaaagccattttagcagtcttttacaggccaatcgcctcttttaagcttttcagataacggcggctgaccggcacggttaagccattacgcaaaatcaactcggcctggccgttatcttccagacgaatctcctgtaaatgcgcgaggttaaccagatactgacgatggcagcgcagtagtggtgtacgactttccagggtacgtaatgtcaattcggtaaagccctctttcccttcgtggctggtaacgtagacaccgctcatccgactgctgacaaatgccacatctttcatttgcagcaaataaatccgactatgccccgtacaagggataaatttcagcgcctgttgattttccggtaacagcgaaacatcctgcttgctgcgctcctgacgcaatcgcgccagcgttttctccagtcgcgcttcatcaattggcttcagcagataatcaaaggcatgttcttcaaaggctttaattgcgtattcgtcaaacgcagtgagaaaaacaatatacgggcgatgttccgggtcaagcatccccaccatttccagaccactgatgcgcggcatctggatatcgagaaacagcacatccgggcgcagtttatgcaccgcgccgatcccttccacggcgtttgaacactctccaacgatttcaatatcgctctgctcctgcaaaaatacacgcaggttctcccgtgctaacggttcatcatcgacaattaagactttaatcatgcctcgtccctccatggtagtcgtaacgttattcgggtgtaactatcaggctcacaggcgacgcttattccatagtcatcgccaaaccgttcacgtaaacgcttatccaccagattcatccccagcccactggcattggttaccggttgatacaaaccggcattgtcttcgatctccagcatcaaatgttgcccctcacgtcgggcgctgattgccactcgccctgtatccagcagttgtgatgtcccatgtttaatggcgttttccactatcggttgcagggtaaacgcgggcaattgctgctgggataattcttgcggaatagcaatgttgacctgcaaccgcgactggaagcgcgccttttcaatttgcagataagcattcacatgttcaatttcgtcggcgagagtaacaaactccgaaggccgctttaagtttttgcggaaaaaagtggaaagatactgcaccagctggctggcctgttcgctgtcgcggcggatcaccgctttaatggtgttaagcgcattaaacaaaaaatggggattcacctgggcgtgaagcagtttgatctctgactgggtgagcatcgctttttgccgctcatattgcccggcaaggatctgcgccgaaagcaattgcgcaatcccctcacccaacgtgcggttgattgaactgaataaacggtttttggcttcatacaatttgatggtgcccatcacccgctgattttcaccacgcaacggaattaccagcgtcgaccccagtttgcattgcggatgcaaagagcaacggtaaggtacttcgttgccatcagcgtagaccacttcaccggtttcaatcgcttttaaagtataagttgaagaaatcggtttgccgggtaaatggtggtcgtcaccaattccggtaaaggccagcaatttctctcgatcggtaatcgcgactgcaccaatatccagttcctgatacagcacctgagccactttcatgctgttcacttcgttaaacccctggcgcaaaatgccttccgtcgaggctgccactttcagcgcagtggcagaaaaagccgaagtgtatttttcaaacatcgcgcgtttatcgagcaatatacgcataaacagcgccgcgccgacggtattggtgaccatcattggcgcagcaatattactcaccagacgcaccgcatcttcataaggtcgggcgatcgcaaggatgatcagcatttgcaccatttcagcgacgaacgtgacggcaccggcggtaatggggttaaagactttatcagtgcgcccgcggcggatcaggatgctgtgtaccaggccaccgagtaatccttcaacgatggtcgagatcatgcaacttaacgcggtcatgccccccatcgaatatcgatgtaagccgccggtcagcccaaccagcccaccgacgaccggaccgccgagtaagccgcccattaccgcgcctatcgcacgggtattggcaatagaatcgtcaatgtgcaacccaaaccaggtgcccatgatgcagaagatggaaaagacgatgtagcagagaaatttatgcggcagacgaaccgtgacctgcattaacggtatgaataatggcgttttactcattaaccatgcaatgactaaaaaaacgcacatctgctgaagcagcagcaacaccagattaaaatcgtacatacccgcaaaccacacttccctttaaaacgcgtaacatacattgcctgcgtttaactttctttgaactcttgcagaaaaatgagaattcgtgagtacgatcactcaaaatcgcctggcaaaaataaaatcaccctatagatgcacaaaaaacgggcaaaactacctggttcgcaaaactgcgtctaaagttaaaccgggacctcgcgagcaagggtgagacgatggcgctttacacaattggtgaagtggcgttgctttgtgatattaatcctgtcacgttacgcgcgtggcagaggcgttacggattgctgaaaccgcaacggacagacggcggtcatcggctgttcaacgatgccgatattgaccggatccgcgagatcaaacgctggatcgacaacggcgtgcaggtcagcaaagttaaaatgctgctcagtaatgaaaatgttgatgtgcagaacggctggcgcgatcagcaagaaacattactgacttacctgcaaagcggcaatctacatagcctgcgaacgtggatcaaagagcgcggtcaggattaccccgcccagacactcaccacacatctgtttattcctctgcgccgacggcttcagtgccaacaaccgactctccaggcgctgctggcgatcctcgacggcgtactgatcaactacatcgccatttgtctggcttcggcacgtaaaaaacagggtaaagatgcgctggtggttggctggaatattcaggataccacccgtctgtggctggagggctggattgccagtcaacaaggatggcgcattgatgtcctcgcccactcgctcaatcaactacgccctgaactattcgaaggccgtacattgctggtgtggtgcggtgaaaatcgaacctccgcccaacagcagcaactcaccagttggcaagaacaaggccatgatattttcccactcggcatttaatgattcgttaacaaatgcgctttactgtacaatcctttcgttaacataaggagtgcattatgcgcatagctaaaattggggtcatcgccctgttcctgtttatggcgttaggcggaattggtggcgtcatgctcgcaggttatacctttattttgcgtgctggctaagcgcctgcaccagcctttcaaacaggcggtctgcgatgatcgccgccagtgccaccagtaacgccccctggatcacatacgcggtattaaatccgctaagcccgatgatgatgggcgtacccagcgtgctggcccctaccgttgaggcgatcgtcgccgtaccaatgttgataatcaccgaagttcgcacgcccgccagaatcaccggagccgccagcggtagctcgaccttacgcactcgctgaccacgactcattcccatacctttcgcaacttctgtcacgctggcatcaatcgctcccagcccggcaagtgtcgcctgcaggacgggcagcacaccgtaaaggatcaaggcgataatcgctggttgcagaccaaagccgatcaccggaacggcgatcgccagcactgcgacgggcggaaaagtctgtccaacggcggcaatagtttccaccagtgggcgaaattccgcgccccacgggcgagtgacagcaattccggcaccagtgccaatgatcaccgcaaacaaactcgaaattcccaccagccagaaatgagccagtgccagagctgcaaaactttcttgctgataaacgggtcgtggcagttgtgggaacaaggcagcaaacagcggctggctgtaaggcagccagaaaatcagcgccacaaacagagcaatgagccagaacagcggatcgcgcaacatcttcatacgcttacgcctccaccagcagatcctgaaaatgcagcgtgccgcaaggctggccctgcatgttcaccaccggcagcacctcgcatccccgcgcaacaaacagagagagcgcatcgcgtagcgtcatctcttctgccagtgcctcaccatctgctcgttcttcgcgacgcacgtaatccgccacactacgtaacgaaagcaggcgcacacccagttcactacgtccaaaaaactggcggacaaaatcattcgccggacgagtcagcatcgtcagcggattgccctgctgcactacttcaccgtgatccatcaataccagatgttctgccagccgtagcgcctcatcaatatcatgagtgaccagcacaatggtacgccccagcaaacggtgaatgcgcgtcatctcttgttgcaacgcgccgcgcgttaccgggtccagtgcgccaaaaggttcatccattagtaagacttgcggatcggcagccagtgcacgcgccactcccacacgttgctgctgaccaccggaaagctgatgcggataacgctcacgcaaatttgactccagccccagtagcgccattaattcgtcgatacgatcgtcaatccgcgcccgcgaccatttttgtaattgcggcacggtagcgatgttttgcgccacgctccagtgggggaacaggccaatagattgaatggcatagcccatccggcggcgcaactccagtactggcagcgagcgaatttcttctccggcaaagcggatctctccgctgtcatgctccaccaggcggttaatcattttcagggtggtggatttgccggagccagatgtgccaatcagcaccgaaaaactcccttcctgaaaattgagattgagatcgttaacggctttttgtgcgccgaacagtttgctgacatggctaaattcaatcattacgtttcaccttcagcagtgcgataagcaaatcgaacagcgcgtcggtaagcaccgccagaacaattaccgggatcacccccagcaacactaaatcaatggcgctgcttagcagcccctggaaaaccagcgcaccaaaaccgcctgcgccgattaacgccgcaatcaccgccatacctacagtttgcaccatcaccacccgcaggctgcgcagaaataccggtaacgccagcggtaactgaacatgcaggaaacgctgcgccccgctcatccccatcgctctggcgctttccagcacatcgcgcgggatctggttcaaaccgactaccacgccgcgcaccagcggcagcaaggcatagagcaccagcgcaatcagtgcgggtgtcattccggttcctgctatgccgagcgtccccagccacggaaaggccgtaaccagcgcggcaagcggcgcaatcaacaggccaaagagcgccaccgaaggcacggtctgaatcacattgagcagagaaaaaattgccccctgccgagcagtggaaaagtagcaccagatgcccaacggcacaccaatcactaacgcaggcagcaccgcaccaaacagcaacgtcagatgttgtgccagcgcgtcgtcaaacacatcctgacggttggcgtattctttcattagtgagagatcgttaagcgtgccggagtacagcaaccacagcggaataatggcaatctgcatatgcaacaaccagcgccacagcggatgcgtggagattcggcggatggcatcgctacaggccagcaatgccagcgccgcagccagccagaaaccactgccgaggctggtacgcgccagcgcactgccattttgcgccagttgggtcgccgcctttccagctccccacaccagcaatacgaagacgaattgcgccagaatgagtgcacaaatgctgccttttttaccgggaataaaacaggccgtcagccaggcgcaaccaacgcccaccagcatccagatcgtttgcggccacagctgccagagatgacgcccctcacccgaaactaaacgattaggcgcgtaactgataaacggcagcgccgctgcgattgccgtcagcaacagcagcagcgccagaacaggattaatacggaaataagtcacgggaaattacttcgtccaccctttttgtttcaggtagtcggcagccacttttttggcatccagtccttccacagcaatgctggcattcagttgctgcaatgtttttgcatcgaggctggcgaagactggctgtagccactgtgccatttgcggatactccctcaacaccgactcacgcaccactggtgcaggcgcgtagataggttgcacaccttgcggatcgcttaaggtttgcagccccagcgccgctaccgggccgtcagtgccgtaagccattgcagcattaacgccagaggtttgctgggcagcggctttgatcgtcaccgccgtgtcgccaccagccagtgacagcaactgatcctgaccgagcttaaagccataggctttttcaaacgcgggtaacgcatcggcgcgttcgataaactctgccgaggctgccagtttgaaggtgccgccctcttgcagataacgactcaggtcggcaagcgaagtgagtttatttttctctgccacatcctgacgcacggcgatagtccaggtgttatttgcaggcgcgggcgtcagccagattaacttgttgtgctccgaatcgagctttttgactttctcgtaaccttgctgcgcgtttttccacgctgcatcgttttcatctttaaagaagaaagcgccattgccggtatattccggatagatatccagttcaccggaagtaatcgccccgcgcaccacaggagtcgttccgagttgcactttattcaccgtcggtacgccgtggctttccagcacctgcaaaatgatattgccgagtagcgcaccttcggtatcgatttttgaaccgactttaacgggggaagccgcctgtagcggcaggctcacggctgccaacataaccagtgaacctgcccagagctttaagagtggcatgatgctttcctcattcttttactgttgttttcagcgaattaagagaaaagcatagttgataatggcggggttagcttgagcggaaggattcagttgcagaatcagataaatacttaagaggcatattcggtccggcgtttcctgccggatgcggcgcgagcgccttatccggcctacaaagggcgcaaacgtcgcgcccttactaaagcattacagcaactcaaactcgcctttcttaacgcgtgcggaatcagtgccgataaagacattgaacttgccaggctcggcgtcatatttcatctgttgattccagaacttcagcgcctcaatatcgatcgggaagctgacagtctgagtttcgcccggtttcagggtgattttctcaaagcctttcagctgtttcacagggcgactcatggaagccgtcacatcctgcaagtacatctgcactaccgtggcaccctcgcgcttaccggtgttcgtcacctgcacgctggcagtcactttgccgtcacgcttcatggtcggcgcagaaagtttcacatcagagacggtgaaagtggtgtagctcagcccatagccgaacggatacaacgccccgttagcttcatcaaaataacgcgaagtgtatttgttcggcttgtcggcattatacgggcgaccggtattcagatggctgtagtacaccgggatctgcccgacagaacgcgggaaggacattggcagcttgccggacgggttgtaatcgccaaacaatacatcggcaattgcattaccgccttcagtccccgcaaaccaggtttccagaatcgcatcagcctgctgatcttctttcaccagcgccagcggacgcccgttcatcagcaccagcaccagcggtttaccggtggctttcagcgccgcaatcaagtcacgttggctttgcggaatagtgatatcggtccggctggaggcttcgtgcgccatcccctgtgcttcaccgactacagccaccaccacatcagattgtttcgccgtctgcaccgcttcatcaatcatctcttgcggcgaacgcggatcgactttgaccgcttcttcatactgattcaggaaatcgataatgcctttgtcactggtaacgttcgcccctttggcatacagcactttaccgttttcaccgacggcatttttaatcccggtcagtacggtcacggattgatcggcaacaccggctgcggaccagctgcccatcacgtcacgtttactgtccgccagtggcccaaccaccgcaatggtggccgattttttcagcggtaacgtttcgagacggtttttcagcaacaccaagctttcgcgcgccacttcacgcgcttctttacggtgcaggcggctttcggcattggtatccaccgggtcagactctttcggccccaaatggctgtatgggtcgttaaacaaccccatatcatatttaacgttcagtacatggcgggcagcatcgtccagctctgccatcgtcactttgccggatttaatcaacccaggcagatacttcgagtagtactcgtcgctcatgctcatgttgattccggatttcagcgccacgcgcaccgcatcttccgggtctgccgccgtgccatgtttaatcagctctttgattgcaccgtgatcggaaacggtgatgcctttaaagccccactggtcgcgcagaacatctttcagcagccaggaatcggaggtggctggcgtgccgttcagcgagttcagcgccaccatcaccgcgccgctgcctgcgtccagccccgctttgtacggcggcatataatcattaaacaggcgctgcggactcatatcgacggtgttgtactctttaccgccttctaccgcgccgtatgcggcaaagtgtttgacgctggtcatcaccgagtagcgatctgccgggcttttaccctgcatcgcttccaccatggttttacccattgttgaggtgagatacgtatcttcgccaaaaccttcggaagcacgtccccagcgcggatcgcgcgagacatcgaccatcggtgcccaggtcatattcaggccatcatctgccgcttcataagcagagacacgtccgaccgttttcactgcatcgaggttaaaagacgaggccagaccgaggctaatcgggaacaccgtgcgctgaccgtgcagcacgtcgtaagcaaagaaaagaggaattttcaggcggcttaattccatcacctgatcctgcatggcgcggatatcctgacgggttacggtgttgaaaatcgccccaacctgaccgtctttgatcatctcgcggatcgcctctttcgggttatccgggccgacgctgattaagcgcagctgaccaattttctcatcaactgtcattttcttaagcagttcggtgacgaacgcatcccgcgcttcgggcgttaatggatggttgccgaataaatcatccgccagtgctggctgcagggccagactcaccgcgattcctactgaacatagccatttcatatggatttttcttcctttgttgcccgacgtggcagcgaaaatggtgcaaaaaccgtagtttgccataagcatgatggagagagaaaaagaatgctcagtttattgtctgaattttcaaaatattcactcgctgaattgttatacaaggcgctattctagtttgtgatattttttcgccaccacaaggagtggaaaatgtcttccatgacaacaactgataataaagcctttttgaatgaacttgctcgtctggtgggttcttcacacctgctcaccgatcccgcaaaaacggcccgctatcgcaagggcttccgttctggtcagggcgacgcgctggctgtcgttttccctggctcactactagaattgtggcgggtgctgaaagcctgcgtcaccgccgacaaaattattctgatgcaggccgccaatacaggcctgaccgaaggatcgacgccaaacggtaacgattatgatcgcgatgtcgttatcatcagcaccctgcgtctcgacaagctgcacgttcttggcaagggcgaacaggtgctggcctatccgggcaccacgctctattcgctggaaaaagccctcaaaccgctgggacgcgaaccgcactcagtgattggatcatcgtgtataggcgcatcggtcatcggcggtatttgtaacaactccggcggctcgctggtgcaacgtggcccggcgtataccgaaatgtcgttattcgcgcgtataaatgaagacggcaaactgacgctggtgaaccatctggggattgatctgggcgaaacgccggagcagatccttagcaagctggatgatgatcgcatcaaagatgacgatgtgcgtcacgatggtcgtcacgcccacgattatgactatgtccaccgcgttcgtgatattgaagccgacacgcccgcacgttataacgccgatcctgatcggttatttgaatcttctggttgcgccgggaagctggcggtctttgcagtacgtcttgataccttcgaagcggaaaaaaatcagcaggtgttttatatcggcaccaaccagccggaagtgctgaccgaaatccgccgtcatattctggctaacttcgaaaatctgccggttgccggggaatatatgcaccgggatatctacgatattgcggaaaaatacggcaaagacaccttcctgatgattgataagttaggcaccgacaagatgccgttcttctttaatctcaagggacgcaccgatgcgatgctggagaaagtgaaattcttccgtccgcattttactgaccgtgcgatgcaaaaattcggtcacctgttccccagccatttaccgccgcgcatgaaaaactggcgcgataaatacgagcatcatctgctgttaaaaatggcgggcgatggcgtgggcgaagccaaatcgtggctggtggattatttcaaacaggccgaaggcgatttctttgtctgtacgccggaggaaggcagcaaagcgtttttacaccgtttcgccgctgcgggcgcagcaattcgttatcaggcggtgcattccgatgaagtcgaagacattctggcgttggatatcgctctgcggcgtaacgacaccgagtggtatgagcatttaccgccggagatcgacagccagctggtgcacaagctctattacggccattttatgtgctatgtcttccatcaggattacatagtgaaaaaaggcgtggatgtgcatgcgttaaaagaacagatgctggaactgctacagcagcgcggcgcgcagtaccctgccgagcataacgtcggtcatttgtataaagcaccggagacgttgcagaagttctatcgcgagaacgatccgaccaacagcatgaatccggggatcggtaaaaccagtaaacggaaaaactggcaggaagtggagtaaaaattacggatggcagagtatcgccatccgaattcacttaatcgttctgtgccgtctgccccgccgccgccatttgggcggctttttgttttttatagctcaacgctgctgccggcacaggcatcactttaccggtttcaatccaggtacgcaggcggctggcatcggcaaaatgggtatatttgccaaacgcgtccatcactaccagcgccaccggtttattattgataaccgtacgcatcaccagacaatggcccgccgcattggtaaagccggttttggttaactgaatattccagttatcgcgatacaccagatgattagtattgcggaacggcagcgtatacgtcggattagagaaggttgccatatcttcccgggtagtacttaactgcccgatcaacggatattgtttgctggcaatgagcagtttggttaagtcacgggcagttgaaacgttatgcaccgacaatccggtaggttcaacaaagcgcgtgttgttcattccgagcgatttcgctttcgcattcattgccttaataaaggctttgtaaccaccgggataatggtgcgcaaggcttgccgccgcgcggttttctgaagacatcagcgccagcaacagcatatctttacggctgatttcgctattcagtcgtacgcgcgaatagacccctttcatctccggcgtctggctgatatccacttttagtttttcatccagcggcagtcgtgcatccagcacaaccatcgcggtcattaatttgctgatagacgcaatcggacgcaccagatccgggtggttcgaatagatcactttgttggtattcagatcaacaatcatcgcgctaccggaggcaatttccggttgtgaagcggtggtagcggctgccgttttcgcaacggcctgcggtgcaaaaggcacagccagcatcagggccaggctaaataaagaaactcgaaatttcggcatgatgagcattcagatagtggttcacgcgcacgggttgcgcaccgccggagtaaggatttactgaggctagcgacgccatcataacgagcaaaaagtgcgatcgtcaaaggagaatcgtgaggaaatgctgcattgctgacatttacgccagcaatgcaacgtcaaagaactttctagaacaaacgataaccgtagccccatagtataacggttagggcgagcagcacttccagtaccagcacgccaatcgccagcgtcgaactagagaagctaaggccttcctctttgttgatattcaggaagctcggaataccaaggtaaagcaggtagccggtgtaaaacagcgccaccgtgccgaccagcgcacacaaccagaccagtggataaagcgccaccagaccgcttaaaaacagcggagttgcaacgtagcccgcgaagaccatgcagtgcgcaagtgacggacgctgcggataattacgcgccatccaccagatgacccgccccatcaccgcgaccccagccagcataacgccgtaaaacaagacagccagcgccagtccggtaaaccaggataacttcaggatagtgccatcgccaaaattccagccaatctgtgtagtgccaatgaaggcgcaaatcaccggaatcgccgccatcagcaaaacgtggtgggtgtaatggtgagaaatcgtttcgttttcgcgattaatcacctgcatttcacgatcgggatgggaaaacagtccccagacatggctcataccgcccccttgttgtgagttcatgaacctgacagttcaagtataagtcagcttgtgattattttttgttcgcccatgtaattttcactgtctgatgaacgtcctttttcagcgtgaatgattcacagggtgtatgcttactggcaaccaaagggagacagactggcctatggatctcaatacacttatctcacaatatggttatgccgcgctggtgatcggtagcctggcggaaggtgaaaccgtgactttgctgggaggcgttgcggcgcatcaggggctattaaagttcccgctggtggtactttctgtggcgcttggcggcatgattggcgaccaggtgctctatctgtgcgggcggcggtttggcggcaagctgttacgccgtttctcgaaacatcaggataaaattgagcgggcgcagaaacttatccaacgccatccgtatctgtttgtcattggtacgcgctttatgtatggctttcgggtgattggcccgacgctgattggtgccagccagctgccgccgaaaatctttctgccgctgaatattctcggcgcatttgcctgggcgttgatttttaccactattggttacgctggtggtcaggtgattgcgccgtggttgcacaatctcgaccagcatttgaagcactgggtctggttgattctggtcgtggttctggtggtgggcgtgcgctggtggctgaaacgacgcgggaagaaaaagccggatcatcaggcgtaaaaccattgccctggataaggcgttcgcgccgcatccgacatccggagtaccatgcctgatacgacgcttgtgcgtcttttcatgccgaccaaaatattacccaatgaaatatccacgcacctcactgcgctattctgggttgaactgtggattcgccaacataaagccgccatccactatcaacgactgcccggtggtgtaatttgcgccctccgaacaaagccacaccaccaggctggcaatctcatgcgttgcgccaaaacgccgcaagggaatcgaaggctccgcgtcgggcttcacgtcgctgtcatccatgccattcattggcgtggcgatcgccccaggcgcgactgcgttcaccaaaatcttatgcctgaccagctccagcgccatcgctttggttaacccaccgagcgcatgtttagcggctgtgtaggcgctggcatccggcagcggcgtatgttcatgtaccgacgtaatgttgatgatgcgaccgccctgcccttgtttcaccatctgacgagccgcaatttgcgagcataagaatgcaccatcgacatcaacggtaaaaatcttgcgccactcatcaaaagccatatcaagaaacggcgctttggtcattgcacccgcattattcaccagcacatcaatgcgccccagccgttgaatgagtttctccagcgccagtgccccttctggtagattgccgagatccagctgcacgatctccgcacgtacgccgtggctaactacctcacgcgcggtatcttttgccccttcttcatctgagtgccaggtaataccaatatcaaacccctgctgcgccagtaataacgcgcactctttgccgatccccgaatcggaggcggtaataatcgcaacctgtgccatcgagttctccacttaacgctgaataaacgttaagtatagaaggcgcatatcatcagcgtttgtaccccccgcccaacgcaccagtgagttgaatggaggcatccagccactgcccttgcaataacaggccattggcccgctcacgcagcgcggggattctggcttcgctgacgcgggaaccagcaatgatgcccgcgttaaagcgcgcctgcgcaagacctaccacacgcaaggcatcgcgctcaatttgcgcctgatgctggtttttctccgccagtgtctgaacctgactggctgcccgcgccacgtcattcaccgcttcaaccaccgctttgttgtagctggcgatagacaagttgctttcggcttttgcgatatcgagattggcgttaagacgaccactatcgaaaatgggtagcgtcaggcctgccgtaacgcccatttgctgcgcggaatgacggaacagatcgcttaagtgcaacgcatcctgttgcaggaaggccatcaggttgatgtcaggataaaatgccgcttttgccgcatcaatggtgcttagcgatgactcaacgtaccagtgcgccgcctgcaaatctgcccgccgggccagtaaggagtaccccagttcatcaggaagctggcttgccactttcggcaacgcgaccggtttaagcttcaatgactttgtctggttatttgtaagtgcgcttaaccgtgcctcaataattttcattttccccgcgacatcgttgagctgctgccgggttttgctggcattaatatcggtttccacaccttcaactgaagaagtaatcccgttctgatatagctggcgatcggtcgcgataatggtgttctgctctttttctatttgctgcaagaccgtgtttaacgccgcctgggtttgccactcccagtacaggcgggctacgctgccagccagcaattggcgggtttgctcgcgttccgccgcccgtgctttaaccgtacccaggcgggcagtaacctccgcccgattctttccccagatatcgagatgccagcccgccgttaagccaaaagtaccgttggtgtaccacgggccggtcgtacctgcggccggatcgttcagagcaaacggccccattaagccttctgccgacattttttgccgctccatatccgccgaaaagtcgatctgcggaccatcctgagtggcaactgccttcgcctgggcttcagctagctgaatgcgctgttcagccacctgcatatccggtgcgttctgtagtgcattgttaattaaggaagtgagttgattatcgtgatactccagccaccattggctgtctggccaaccattttcagcgccgtgggtaatgcggtgtcaacttgtgcagcgggcgtttgctggcttaacgcctggcgggtttcatgcataggcgcacacccggccagcatcagtaacagcggaaaacaggcgatggctggataaaaggaatcacgattcatgggggaataatcaggtaagaaaaggtgcgcggagattaccgtgtgttgcgatatattttttagtttcgcgtggcaatacatcagtggcaataaaacgacatatccagaaaaatatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcagggggcggccaatcgccgccgccccctgcacccccgggctctggcgaacaaaatcgccgctgcgcggtgccctcggcttatcccttacggctaccgggtcgggcgcgaggtaacatccctgtaaaacgcgccctcagcccacatccatgtgggctgccccggccttcagggaacgcctcggcaattttgacgccaccaaacaaccgtgcggcctattgataaagagctaacacattgtcaaaaaacatcactatggttttttagagtttctcgatatcaattgcctgaatagcccttgcaatatcaggggaattattcaacacccgaacatgctgaaataattccgttgcttcatcgtattctttacgcaaataactcaaccactgtttaatccgcgcaacgtgatataacccggtatcgccctgcttttccagacgggtatatttttgcagcaaagcaaccacctccggccacggcattcgcggttcgttatattttaccacccggctcaggttgggaatattgagcgccccgcgaccaatcatcactgcgtcgcagccgctgatcgccatgcattgttgcgcgctctgccagtcccagatttcaccgttggcaatcaccggaatattcagccgctggcgaatatcgccaatcgcctgccagtcaatatgctccgcgcggtaaccctgctctttcgtccgcccatgcaccaccagctccgtagcgccagcctgttgaaccgcatcggcgatttcaaatttcttctcaccgctgtcccagcccagacgcactttcacgctgacgggcaaatgcgccggtacagcttcacgcatcgcttttgcaccctggtagatgagttcaggatctttgagtaacgtcgccccgccgccgctaccgttaaccgttttcgacgggcagccgcaattgagatccacgccccaggaacctaactccaccgcacgggcggcgttctctgccagccattgtgggaactgacctaacaactgcacgcgcaccagcgtaccagatggtgtccggctggcgttttgtagctcagggcaaatgcgatgaaagacttttaccggcagcagttgatccaccacgcggacaaactcggtgatgcacagatcgtagtcgttaacttcggtcagcaattcacgcaccagagagtcaagcactccctccatcggtgccagtaacacacgcatatcatcacccgcaaaaaaatgaggcgctatgttagcgcctatggtcagcggattaaaggtctgcaaagagggattgctgcaaactgcaatccctctctatgcttgatgtatgcctgagttcgctgcgcattgcgtaatgccggggagcgaaaaaataagcgctgatttcttaatgtgatcggtagcacgttttacgaattaattgtatgatgaatccatctcatctggggtgttgattatgagtaagacactgaacattatctggcaatatttacgcgctttcgtcctgatttatgcctgcctgtatgcaggcattttcattgcttccctgctaccggtaaccattccgggcagcatcatcgggatgctgatcctgtttgtcctgctggccttgcaaattcttccggcaaaatgggtcaatccggggtgctacgtactgattcgctatatggcgctattgtttgtgccgattggcgtaggcgtcatgcaatattttgatttgctccgcgcacagtttggcccggtagtggtttcctgtgcagtcagtacgctggtggtttttctggtggtgagctggagttcgcaactggtacacggtgaacgtaaagtcgtaggtcagaaaggatcagaagaatgatggcgaatatctggtggtcattaccgctgacattgattgtcttttttgccgcccgcaaactggcggcacggtataagtttcccttgcttaacccgttgctggtagcaatggtggtgatcattccttttttaatgctgactggcatctcttacgacagctactttaaaggtagcgaagtgctaaacgatctgctgcaaccggcggtcgtcgcgctggcctatcctttatatgagcagctacaccagatccgcgcgcgctggaaatcgatcatcaccatctgttttatcggcagcgtggttgcgatggtgacggggacttccgtggcattgttgatgggcgcttcaccggaaatcgccgcgtcaatcctgccgaaatcagtcaccacgcctattgcaatggcggttggcggcagtattggcggtattccggcaatcagcgcagtttgcgtgattttcgtcggcatcctcggcgcggtatttggccatacattgcttaatgcgatgcgtattcgtaccaaagctgcgcgcggtctggcaatggggactgcctcgcacgccctcggtacggcgcgctgcgccgagctggattatcaggaaggtgcatttagttcgctagcgctggtgttatgcgggataattacttcgctgatcgcaccgttccttttcccgattattctggcagtaatgggctaaaatttgcgatgcgtcgcgcatttttgatgtatgtttcacgcgttgcataattaatgagattcagatcacatataaagccacaacgggttcgtaaactgttatcccattacatgattatgaggcaacgccatgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcggcctgtgcgcgtacgccattgtcgaattttaatgttggcgcaattgcgcgcggtgtgagcggaacctggtatttcggtgccaatatggaatttattggtgcgacaatgcagcaaaccgttcatgccgaacaaagcgcgatcagccacgcctggttgagtggtgaaaaagcgcttgcagccatcaccgttaactacacgccttgtggtcactgccgtcagtttatgaatgaactgaacagcggtctggatctgcgtattcatctgccgggccgcgaggcacacgcgctgcgtgactatctgccagatgcctttgggccgaaagatctggagattaaaacgctgctgatggacgaacaggatcacggctatgcgctgacgggtgatgcgctttctcaggcagcgattgcggcggcaaaccgttcgcacatgccttacagtaagtcgccaagcggtgtcgcgctggaatgtaaagacggtcgtattttcagtggcagctacgctgaaaacgccgcattcaacccgactctgccaccgttgcagggagcgttaattctgttgaatctcaagggttatgattacccggatatccagcgcgcggttctggcagaaaaagccgatgcgccgttgattcagtgggatgccacctccgcaacgctgaaagctctcggctgtcacagtatcgaccgagtgcttctcgcttaagcctggtgccggatgcggcgtgaacgccttgtccggcttgccagccctctcctggtgtcgaaattcccggcaaacagtttgccgtttcttgcgcaaaaccagcgggtaaagtagcctgatggaaattttccttagatcgagtctcctgcatgttaaagcgcgtgttcctcagcctgttagtcctgatcggcttgctgctgttgactgtgctcggcctcgatcgctggatgagctggaaaaccgcgccttatatctacgacgaattgcaggatctcccctaccgccaggtcggtgtggtgctcggaacagcaaaatattatcgtactggcgtaattaatcagtattatcgctaccgcattcaaggagcgattaatgcctataacagcggtaaggtaaattatctattactgagcggcgataacgcattgcaaagttataatgagccgatgaccatgcgcaaagatttaatcgctgctggtgtcgacccatcagatattgttctcgattacgcaggctttcgtacgctggattccatcgtgcgtacacgcaaagttttcgatactaatgatttcattattatcacccaacgtttccactgtgagcgagcattatttattgcgctgcatatggggattcaggctcagtgttatgccgtaccgtcaccgaaagatatgctgtcagtacgtattcgtgaatttgccgcccgtttcggtgcgctggctgacctttatatttttaaacgtgaaccgcgttttttagggccgctggtccctattccggctatgcaccaggtaccggaagatgcgcaggggtatcccgccgtcacacccgaacagttacttgaattacaaaagaaacaaggaaagtagttatggatgtacagcagttttttgtcgttgccgtttttttccttatcccgatattttgtttccgcgaagcatggaaaggctggcgcgcaggcgcgattgataaacgggttaaaaatgcaccggaaccggtgtatgtctggcgagcaaaaaatcccggactctttttcgcttatatggtggcatatatcggcttcggaattttatctatcggcatgattgtttatcttattttctatcgttaatattcccctctccagttaattattgagaataattattacttcacctgataagctgcggatatcacattcctaaccgcagctatttgtgaatcttttcacagtttaaattcccccgcacgcttagccttaatatcagtacattattatttactaaacgctcgccttaattacctatagcattaaggaagatcacatgccgcaacaaaattatctggatgaactcactccggcttttacgtctttactggcgattaaagaagcctctcgctgtttattatgtcacgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacccgtgccggtgttgatgctcccattgatatcggccgcttacagcgttttgttactgattttgaacaacaaaccggaatggaaatttatcagcccggtactaaaacgctcggcaaagtcgcgattattggcgcaggtcctgccggattgcaggccagtgtgacactgacaaaccagggttatgacgtcacgatttatgagaaagaagcgcaccccggtggctggttgcgtaacggtattccgcaattccggttaccgcaatcagtgctggatgcagagatcgcccgtattgaaaaaatgggcgtgaccattaagtgcaacaacgaagtcggtaacacactcacccttgagcagctgaaagcagaaaaccgcgcggtactggtcaccgtggggttatcaagcggttccgggctaccgctgtttgagcatagtgacgttgagattgccgtcgacttcttgcaacgtgcacgacaggcgcaaggcgatatcagcattccacaaagcgcattaattatcggcggcggtgatgtcgcgatggacgtagccagcacgctgaaagttctcggctgtcaggcggtaacttgcgtagcgcgtgaagagttagatgagtttccggcaagcgaaaaagagtttaccagcgcccgggagctgggcgtttcgatcatcgatggattcacgccagtagccgtggaaggcaataaagtcacgtttaagcatgtacggttatcgggcgaactgacgatggcggcagataaaattattctcgccgtcggtcagcatgccagactagatgcctttgcggagttagagccgcagcgtaacaccatcaaaacacaaaattaccagacccgcgacccgcaagtctttgctgctggcgatattgttgagggtgacaaaaccgtggtctatgccgtgaaaaccgggaaagaagccgccgaggcgattcatcactatttagagggagcttgctcatgttaacgaaagatctttcgattactttttgcggcgtgaagtttcccaacccgttctgcctctcttcttcgccggtaggcaactgctatgagatgtgtgccaaagcctacgacacaggttggggcggtgtggtgtttaaaacgatcggcttttttatcgccaacgaagtctcgccgcgttttgatcatctggtgaaagaagataccggttttatcggcttcaaaaatatggagcagattgctgaacatccgttggaagagaatctggccgccctgcgtcggctgaaggaagattacccggacaaagtattgatcgcttcgatcatgggggaaaatgagcagcaatgggaggagctggcgcgcctggtgcaagaagctggcgcggatatgatcgagtgtaacttctcctgtccgcaaatgacttctcatgcgatgggtagcgatgtcgggcaaagcccggagctggtagaaaaatattgtcgggcagtgaaacggggttccacgctgccaatgctggcgaagatgacgccgaatatcggtgatatgtgcgaagtggcgctggcggcgaagcgcggcggcgcagatggcattgcggcgattaacaccgttaaatccatcaccaatatcgatcttaatcagaaaatcggtatgccgatcgttaacggaaaatcgagtatttccggatattccggtaaagcggtaaaaccgatcgccctgcgcttcattcagcaaatgcgcacccatccagaactgcgcgatttcccaatcagcggtatcggcggcattgaaacctgggaggatgcggctgagtttttattgctcggcgcagcaacgttacaggtgaccaccggcatcatgcagtacgggtatcggatagtggaagatatggcaagcgggttgtcgcattatctcgccgatcagggatttgattcgctgcaggagatggtaggtctggcgaataacaatattgtcccggcggaagatttagaccgcagttatattgtctatccccgtatcaatcttgataaatgtgttggctgtggacgctgttatatttcctgttacgacggcggtcaccaggcgatggaatggagcgagaaaacccgcacaccgcattgtaataccgagaaatgtgtgggttgtctgctttgtggtcacgtctgcccggtgggttgtattgagctcggggaagtgaagtttaagaaaggcgagaaagaacacccggtaacgttgtaaaaccagagacgcatccggcatttggttcctgtcgccggatgcggcttgaacgccttatccggcctacaaaaccatacaaatcagtatgttgagcttattgtaggccggataaaacgcgccagcgttgcatccggcatttggctcctgttgccggatgcggcgtgaacgccttatccggcctacaaaaccacacagatcatgatgttatgtgcgtttatgaccgaatgcggaccacattcacatcatttcttacgcgcgtatttcagtgaatccagcgctacggcgaagataataatcgcccctttgatgatgtactgccagtatgggtttacgccgatatacgtcaggccatagttgatgacggtaaaaataattaccccggtcaccacgccaatcaccgtccccacaccgccgctgaacgatacaccgcctaccacgcacgccgcgatagcatccagctcatacataaagccgaggttgttggtggcagagccgatacgtccggcttctaacatcccgccaaaggcatagaacacgccagacaacgcgtagatcatcagcaggttcaggccgacgttgacaccagatacttttgccgcttccgggttaccgccaatggcaaaaatgttcttaccgaagcgggttttgttccacaacacccagacgaacgccaccgcaatcaacgcgtagaaggtgatgtaagagagacggaaactccccagcgcgacaaagccctgagcaaaggtagagaagccactgtcaaaaccagaaattggcgacgccccgacaaagtcgtaatagagcgagttgatgccatagacgatgatcatcgtgccgagcgtggtaatgaacggcgtcacgttgagataagcgataatcagaccgttgatcaaaccgatcaccgcaccaatggcacagacaatcagaataaccagcgcaatcggcatcgtcgccatttccgggaacactttgttggcgttatccatggactgcaataatgtcgcagccaccactgccgccagccctacctgacgaccagcagaaagatcggtcccctgggtgacaattaaccctgccacaccgagcgcgataataatacgcaccgatgactgggtgagaatattacttaagttcaacagacttaaaaatgttgggtcctggaaaataataatcgccagcaaaactaaaagaacgacgtaaataccgccctctttcaggtaagtaagaaaacttttcttatttaacgcactcatgggaagcccctaatcttaaaggtgcaaagacgcaagacgcagaatttcgttttgcgttgttgtttttgtatcgacaattccggaaacgagaccattgctcatgaccagaatacggtctgttatccctaacaactcaggcatttcagaggagataataataatccccttgcctttcttcgccagttcggcaattaactgataaatttcaaacttcgccccgacatcaataccgcgcgtcggttcatcgagcattaatatttctggttgcgttagtagccagcgaccaataatcaccttttgctgattaccaccggagagcgaaccaatttgcgtccgatgacccggcgtttttacccgcatcgaatcaatcacccactgggtatcgcttttcatccgcgagttatccagtaaaccaactttatttttgtagttgcgaatattggaaattaacgagttaaaaccaatatccagataggcataaattcccgttgagcggcgctcctcagttaccagtgcaaatccatggtttatggcttcgttggcattatggttattgatctgtttgccgtgcaacgttatggtgccagccgatttctcgcgaataccaaataacgtctcaacaatatcggtacgtttcgcccccaccagaccggcaataccgaggatctcccctttatgcagatcaaacgagacatcgcgaatcgacggctggcgcagtgacgtcaggttacgtacctcgaggatgacttcgcccggtttgttttctttgtcagggaaacgctggttaagagaacgcccaaccatcatggcgatgatcttgtccatcgtcagtcctgccagcggttcggtggcgatccactgaccgtcgcgcaatacggtaacttcatcacataactggaagatttcttccattttatgcgagatataaacaataccgcagccgcgctcttttaatttacgaataatagtgaacagatgattgacctctttttcggttaacgaagaagtcggttcatccataatcacaattttcgcgttataggaaaacgctttggcgatttcgatcatctgcatttgcgaaacggataatgtgccgacgcgcgcacgcggatcgatatcaatatccagttcgtcaaaaatcgctttggtttcgcggtacattttgtcctgatcgacaaacatgcctttggtgggatatcgccccagccacatgttatccatcaccgaacgttgtaataccaggtttaactcctggtgtaccatcgaaataccattttccagggcttcttttgcagaatggaaatcgatctctttaccctggaataaaatggtgccggagtctttttgataaataccaaacaggcattttaataatgtcgattttcctgcaccgttttcccccattaatgcatggatagaatgtggccggacttttaaattaacgttatcaagtgccttaacaccaggaaaggacttgttgataccgctcatttccaacaagtattccccggaggacggagtcgttgagctgaccatataattttaccttgttggccatacaataagggcgcagtaatagactgcgcccaatcagtcttatttcttgctgaattcagccaggttgtctttatctacgccaacataaggtacgcggaccactttgttgtcgattttccagttggtgccatcagccgcacctttaccatcggccaggtttttcgccagatcaaaggtcgctttcgcctggttgttagcatcgttcagtacggtgcccgccagtgcaccggatttcaccagcgccagcgcttctggcagcgcatcgacgccaaacaccggaatgctggacttgttgtgtgctttcagcgcttcaaccgcgcccattgccatcgcatcgttgttggcgataaccacttcgattttgttggcgttcgggccagacagccaggcgtccatcttatctttcgcctgagcggtgtcccacattgcggtatctaactgtaactgttcagttttgatgcctttatcgttcaattctttaatcacgtaagtggtacgtgcttctgcatccggatggcccggttcacctttcagcagtacgaactgaatctgaccgtctttgttcagatcccaaccctgattcgccgcccagtgtttagcaatcaaatcgccttgaataatgccggactctttggagtcagtgccaacgtagtaggctttgtcgtagctatccagcgccttacgagacggttctttgttgaagaaaaccaccggcacgttttgcccacgcgctttctcaatcaccgtacccgcagctgccgggtcaaccaggttgattgccagtgccttcacccctttcgccagcaatacgtcgatctgatcgttctgcttggactggtcattctgagaatcattcatcagcagctgaacatctggcgcggctttcgcatcttgctcaatagccttgcgcactacagacataaagttatcgtcgtacttatagattgttacaccaatgcgagtatcagcagcgtgtgcagcggcaccgaataacatgctggccatcacagcagacagggttaacaccttcttattcatggtatctccggtttttcttatgcagggtagtgcttgagataaatgctcggcggggcagtagagttaatgaagtgttactgaacgccgaagctcactttttaaaattcgttcttccatgcccggtaacgctccagaaaacggctttaattgttgttatgacgctgttacctcggcaaaagtgattattcactgttacatacgggttacaacgttaaaacggtgcaatcatagctatcacattgttaagatactgtgaaatcactcacagattgaaagcggttacatcgcctgatttgttgagttagtgatcgccgccgcattctggcgtgttgcgacagaatggcgacgcactaacgtcggcataaaacagtggctggcacgaggatcaatattgcctgctgccccctgcaaggccagttcggtggctaatttcgccattgaagcaatgggataacgcacggtcgttaattgcgggtcggtgtaacgggcgatgggaatatcatcgaaaccgatgattgagagatgtaacggaatcgcaatgccattatcttttaatgctgtcagtgcgccagcggccatattgtcgttataagcaaatacagcggtaagttgtagattgcgccccagcagttcaaccatcgccgcctcaccgcccggcatgtccggcgtaccagcgccaatccagctttccggcggaataatatcctgctctttcaacgcactcatccagcctgctttacgcatggcgtcatcttcaatgccgtggctggaagaaagataaccaatacgttgatgaccgttattcagcaacatgcgcgtcgccattcgggcaccgctgagattatccaggcaaacgcaacgatgggcgtaccccggcacaacgcggttgattaacaccataccgggaatgttatccataaattgcgccagttcatcgtcactcaatgcttttgagtgaacaatcaacgcattacaacgctggcgaattaacacctcaatggcgtgacgctctttttccgcttcatgatagctattgccgattagcacgtatttctgatgctgctgagcgaccagatccaccgcttttaccagcgcgccgaaaaacgcatcagaaacgtccatcaccaccacgccaatggtgtcgctaacctgagttgccagcgcctgggcattggcgtttggccgataatccagctcactcacggctttcattactgcttcacgcgtgtcggcactgaccagcgtgctgttattgagcacccgggaaaccgttgccacagagacgccagcctgacgcgctacatcacgaatggtgatcatattcactacctgttatgagattgcagtaaatgactgcttgctggcggctattttgtcagcactgaatacaggacttcgtgaatcgagtcacagcaatggaaacggttacagccgttttgttaacgaatgtgatccagatcgttatcttgatgttttagatattgccggtccggcagcacgcaaagttaactgacgccagagccattccaccggcccctggcggaagtaacgcagccagataacagagaagaggatattcgccagccataccggaataacaaacgccagcagctccaggcggtcaaaatgcataaacaaaccgaggtggtaaaaaagcgtggtacaaatcagcgtttgcaatagatagttggtcagcgccatccgtccgacgcaggcgatcgcaagcaccagcttaaagcggctcaattgcggccagaagccataaaacagcgacgcatagccaatcgcctgaaacggcgcactcagttcccgcggcatttgaagtaagaaggcacaccagcgatacgcccagtccagctgccattgcagggcgatggcaggaaggttaatggtcaccccaatcgccaccagcacaaaaccagtacgacgatagtgacgtaagctgaactgccctttcagccagccgctgcgcatcagcgccgcaccaatgagcatcatccctgccagttgccagccatactgtgcgcccagtgccagtaaactgttgccaacaccatcggcacgattactgatcgcttcaacgccgccgtgaagcttccagtatttttcatacaaaatagccgatgcatccggcgtccaggcgcggctggtctggctgtcggaaatcagccccaataacagcaaaacgccaagccccaccagataaagcatgacgcctgtattaaacaggctttttaccgatggcgcatcgcgcaccagccgccagcagattaagcccaccagcccgtaagccagcaaaatatcgccgtcccagaacaataaaccgtgaataaagcccaacaagactaacagcgttaaccgcgactggatccagcgtctgccacggggcagcaacatttgcaggcccgcaccaaacagtagcgcaaaaagcgtgaggaatttcacctggccgatgagatcaagaaatgcccaagtccatgcatcccgcggcgtaatagcaccgtaccaggcgggattgagataagccgcctttggtagcccaaaggcgctgatgtttaatagcaggatccccagaatggcgacgccgcgaacaaaatcgagcgtgacgttgcgctccatggttcctgccttttaatcagttgtgatgacgcacagcgcgcagaaactcgtggcgcgtattctgactggatttgaacaatccaccaagagaggtcgttgtcgtggcactggttgcatcgcggatgccacgcgccttcacgcagtaatgcaccgcgtcgatcgagacagccacgttattggtgcccagcagcgtttgtagcgcaataagaatttgctgcgtcagacgttcctgcacctgcggacgctgggcaaagaactgcacaatgcggttaatttttgacagaccgatcaccgaatctttcgggatataggccaccgtcgctttgccatcgatggtaacaaaatggtgttcacaggtgctggtcagagtgatatcgcgcacggtgaccatttcatcgaccttcattttgttttcaatgagggtgattttcgggaaattggcgtaatccagaccggagaaaatttcatcgacatacattttagcgatgcgatgcggcgtttccatcaaactgtcatcagccaggtcgagattcagcagctgcatgatttcggtcatatgaccagcaataaggcttttgcgcgtttcgttatccatttcatgcacgggcgggcgcagcggtgtttccagtcctcgcgcaactaacgcttcatgaaccagggccgcttctttactgagtgatggcatttatgatttctcctgcaggtgtgacgcctccgccctgcgtgggggcaaagttattaagctgatttacagcctgattattgtgcgtgaggcggcgcacataatccagtattcacagcgataattattgtaattgccgctgcctttcatcagcagatgttaaaacatcgttatgcaaatacggaagtgaaagttactcacagcacattgaataaacggtatgatgaagaaattgcaaacaacacaacaaggagccacgcatggaaatgctcgaagagcaccgctgttttgaaggctggcagcaacgctggcgacacgactccagtaccttaaactgcccgatgacgttcagtatctttctccctccacctcgtgatcacactccgccaccagtgctgtactggctttccggattaacctgcaatgacgagaacttcaccaccaaggcgggtgcccagcgggtagcggcggaactggggattgtactggtgatgccagacaccagcccgcgcggcgaaaaggttgccaacgacgatggctacgatttaggccagggcgcaggcttttatcttaatgccacgcaaccgccgtgggcgacgcattaccggatgtatgattatctgcgcgatgaattaccggcgctggttcagtcgcaatttaatgtcagcgaccgctgcgccattagcggtcactcaatgggtggtcacggtgcgctgattatggcgctgaaaaatccgggtaaatacaccagcgtttcggcctttgcgccaattgtgaatccgtgcagcgtcccgtggggaatcaaagcgtttagcagctatttaggtgaggacaaaaatgcatggctggaatgggacagttgcgcactgatgtatgccagtaacgcgcaggatgcgatcccgacgcttatcgatcagggcgataatgatcagtttcttgccgaccagttgcaacctgcggtactggcagaagccgcgcgccagaaagcgtggccgatgacgctgcgtattcagccgggatatgatcacagttactacttcatcgcctcttttatagaggatcacctgcgcttccatgcgcagtatttactgaagtgaaagtccgcccggttcgccgggcatcttctcatcagaagcgataatccactgccataaagtaacgacgtccgtcttcgttatagctgtagtcgtcacgactgagatccttgtcgccaaggttcagcacgcctgcgcgcagtttgacgtctttagtcacctgccaggccgcgccggtattccagatggtataaccgcccggtgttttagccgtcgcgctgtcggcgcgtttctgcccggtatagtgcccagaaacatagaatgaccagtcttccagcgccagcggtttccagtccagcgtaccgttagcagtatggaacggcagatcggatagcggtttgttttcgccgttgctgacatcacgaccatcgttgtaggtgtagttgatcgacagtttccattcatcgttgaacggaattttcagttcggtttccacgccctgaatacgagctttgttaacgttgtagtagctaaataccggtatgcgccgtccgttagcgcccgtctcaaaaccaacaaagttttggtagcccggtgcagcgttgacgtcagacgtacggctgatgctgatacgatctttcacatcgttacggaaaacggtaacgctggattcaaccccttccagccagccttcttcacccatgtagtaaagccccagctcccaactttcgctggtttctggtttcagatccgggctacccacaatcttacatgcgccacggcaggaattgctcgtccagtcagggctaagttgcaacagagaaggtgctttaaatgccgtcgcccagccccctttcaccgttacggtgtcggtggcgttataaaccaggtaggcacgcggactccagtgttcaccgtaggtttcgtgatcgtccatacgcacgccggtcgtcagcgccagcggctcgaagatccgccattcatcttccacaaacagcgcgtactggctggcagacgttttggagctggttcccccggtcaggttcaccgcatcgctaagtttgtcgtgacgccattcaccgccaaccgtgagaaactgattaatcgccgtcagcggcaacgtgtatttgccgtcgaccgtattgctttcggaagttatcgggctgctgttgccagggtttttgttctcgactttctcaccgtagtatttcagttcgctggtgccgtaatcccaacgcccattatggctgacggagtagttctggcgttccaggcggtttttgtccagcgagtcggaatcacgatcctgacggtcgaaaccgtatccggcagtaaaatcgtgattttgattcggtgtccaggcaaattcgacattgccgtcgcggctggagaatccttcaatacgcggcgtttctccggtatcggtggtcgttgagttttgcgggtcatccttttcacgttttgccaggctgccgtaagctttcattcccagcacaccatcaattaatggtccactggtaaagaactgaccgttataggtgtcaccgcgatcgcgatgttcctgaatggtggtatcgacggtaacggtacccgaccatttctgaccgatttttttggtgatgatattcactacaccgccgagcgcatcggaaccgtacagcgacgacatcgggccacggaccacttcaatacgttcgatggaatcgaccgggatccagttcagatcgaaatcattgtggcggaagacggcattgcgggagttcacgcgtttaccgtcgacgagaatcagggtatagctgctgtccagaccacgaatactaacgcccttacggttatccccttcgttcgtcagttgtacgccaggcacttctttgaggacatccttcagattctgtaccggttttcgctgcaggtcttcctgggtaatgacgctgatactggcaggtgcatctttaagattttgttccacggaagatgcagtgacaaccatcgtttcgccatcatcatcgaccgctaacacaggccatgcacaagaaatagcggacaaacacagcccgacccgtacgaaagggttcaacctaaacattccatatctccatgaggtaactacgaaaataaaatgggttatcgctcacatcttcttcacgtccccttgcgtacggcagcatcgcggtggacttattttttatgcaggtgatcatcccagaaagccggaacagcctctgatttgtcagccttttttgattgcggcgtaacgataatgcaaacgataacaattatcaatccaaatgttaaattttatatccgcatgatttgtcagggaaatggaattgaaaaagccctctcggttgagagggcttagcaaggaagggaggaaacttatttcttatcgttctgcgggaacttcatttcgctgtagcgtacgaagtgagttcctttaatcagcttgtagccgaaccaaataatcaggaacagcgggataccaatatacgttgccgctacgccgccccagtcaatagtatctttcaggaacgcttcgtagttctggcccaaagtgataatcagacacagaatgaatgcgaagatcggccccagtgggaagaaacctgaacggtacggcagatcgttaatgtcgtgtccctgcaatacgtaaccgcgacggaagcgatagtggctaatggcaatccccagccaggcgataaaacccgtcatcccggaggtgttcagcagccacaggtataccgtctggttgccaaacatggaggtcaggaagcacagaccggcaatcaccgtcgtcgcatacagcgcattacgcggcacgccaccacgcgacagtttagcgaaaatgcgcggcgctttaccgtcacacgccagggtgtacagcatacgagtagacgcatacataccggagttacccgctgacagcaccgccgtcagaataactgcgttcatcaccgccgccgcagagagcagacccgcgtgctggaacaccagggtgaacggactaacgctgatgtctttaacatcgttacgcagcaggctcggatcggtgtacggaataatcaggctgataatcaggatcgcgaacacatagaacaacaggattcgccagaacacctgacgtaccgcgcgtggaatgtttttcgccggatcttcggactcgcctgcagcaataccgatcagctcggttccctggaaagagaagccgacaatcatagctacgccgatcatcgccgcaaaaccaccagcaaacggcgcttcgccgattgtccagttgctccagcccgcaggctgcgcgcctttgaagataccgataatcatcagcacgccaacgatgataaagacaataactgtcgtgactttgatcagtgagaaccagtattccgcttcaccaaagccacgaactgagatgtagttcagcaggaagataacgccgaggaacaacgcactccagatccagcccggtgtatccgggaaccaccagctcatgaccagctgagctgcaaccaggtcaacggcgatagtcaccgcccagttgtaccagtagttccagcccagcgcgaagccaaagccttcttcaacatagttctgaccgtaagtggcaaacgaaccggaaaccggcatatatgcagccagttcaccgagactggtcatcaggaagtaaaccatcaggccaatcagcatatacgagagcaatgccccgcccggacctgcctgagaaatcgttgcgccagaggcaacaaaaagacctgtaccgatggaaccgccaatggcaatcatcgtcaggtgacgcgcctttaattcacggcgtaagcccggcgcttctgtggttttagtttcggaaaccatacaaaaatgctatccatcttaaaaatgaggcgcgattgtagcagacgattggcaatccttccggcagaaatacacggttataagacaccttcatgatcgcccagggattataagtaaagcagccaatctcttttctggcgaatgcatgctgaaggcgctgcgtcacgaaatcgacacagcaccagcatgttcttgtacagcaacttaacgcggcacatttgcgggatcgcaatagtccagaaagcgccgtagcgcgttggaaaggtgtttttgccgatgatgtatacgccacaacgtacgcatcaggcgcggcagagggaccgcaacttcacttaatgtgcctgcctgcaattgatcttcaatcacacgtcgcgacaggcaactaattcccaacccatgacgcaccgcatgtttgattgcctcggagttacctaattccatcgccatctcaaacttcggtaaatgtgacagcaacagataatcgacaatctcccgcgtgccggaaccgcgttcacgcaggatccacggcgcagcggccagctgttctaaggtgaccggaccacgggccaacggcgaagtcggcgcggcgaaaaccaccagctcgtcttccagccacggttcagaaatgatttcagtgctgtggcacggtccttcaataaagccaatatcaacgcggaaatccagcaccgcttgcatcacgtcctggctattcccaacgctaagttcaatcggcaactgcggataatcatggcgataacgggcgataactgcaggcagaatgtagttaccgatggtactactggcatagatacgaatcgcgccgttgtcttcgcgaaacagttgttcgatttcaaccgcctgttcaagcaatgccaacgcacgcggatagagcagccgcccgtgttcattaacaaccagtcttttccccacgcgatcaaacagttgcacgccaagctgcccttccaggtcggtcaaggctgcgctcactgctgattgcgacaacgccagcatcaccgacgcctgggtggttgatccacttttcaatacttctgcaaaaacttccaactgccggagggtgatgtgcatagtcgcttaccacttataaagattaattataaatatataatcaattttatttttaaaccagttagtcgtaaccttatgcccggttaaaggagagggttatgacgaatatcaccttacagaaacaacatcgtacactgtggcattttattccggggttagccctgagtgcagttatcaccggggtcgccctgtggggtggttccattcccgcggttgcgggtgccgggtttagtgccctcaccctcgcaatcttgttggggatggttttaggcaacaccatctatccgcacatctggaaaagctgtgacggtggtgtgctgtttgccaagcaatatttattacgtctgggtatcattctttatggcttccgtctgacgttctcgcaaattgccgatgtcggtatcagtgggatcatcattgacgtgttgacgctgtccagtaccttcctgctggcttgcttcctggggcagaaagtgtttggtctggataagcacaccagctggttgatcggtgccggtagcagtatctgtggtgctgccgcggtactggcgactgagccggtagtgaaagcggaagccagtaaagtaaccgtggctgttgcaaccgttgttatcttcgggaccgtcgcgattttcctctacccggcgatatatccgctgatgtctcaatggtttagtccggaaactttcggtatctacattggttctactgtgcacgaagtggcgcaggtggtggcggcaggtcatgccatcagcccggatgcggaaaacgcagcagttatttccaaaatgctgcgcgtgatgatgctggctccgttcctcatcctgctggcggcgcgtgttaaacagctgtctggggcgaacagcggcgagaaaagcaaaatcactattccgtggtttgccatcttgttcatcgtagttgccatctttaactcgttccacctgttaccgcagagcgtggtgaacatgctggtaacgctggataccttcctgctggcaatggcgatggcggcgctgggtctgaccactcacgtcagcgcgctgaaaaaagctggggcgaaacctctgctgatggcactggtactgtttgcctggctgattgttggtggtggtgcgattaactatgtgattcaaagcgtcatcgcataaaccactacatcttgctcctgttaacccgctatcattaccgttttcctccagcgggtttaacaggagtcctcgcatgaaatacattggagcgcacgttagtgctgctggcggtctggcaaatgccgcaattcgcgccgccgaaatcgacgcaaccgcgtttgccttgttcaccaaaaaccaacgtcagtggcgtgccgcaccgctcacgacgcaaaccatcgatgaattcaaagccgcctgtgaaaaatatcactacacatcggcgcaaattcttccccacgacagttatctgattaacctcggacatccggtcactgaagctctggaaaaatcgcgcgatgcctttatagatgaaatgcagcgttgcgaacagctggggctttctttgctcaacttccaccctggcagccatctgatgcagatttcagaagaggattgccttgcgcgtattgccgaatccatcaacattgcgctggataaaactcaaggtgtgacagcggtgatagaaaacaccgccggtcagggcagtaacttagggtttaaattcgaacatctcgcggcgattatcgacggcgtggaagataaatcccgcgtcggcgtctgcattgatacctgccatgctttcgctgccgggtatgatttgcgtactccagccgaatgcgagaaaacattcgcggattttgcccgtactgtcggctttaagtatctgcgcgggatgcaccttaacgatgcgaaaagcacctttggcagccgcgttgaccgccatcatagcctcggtgaaggcaatatcggtcatgatgcgttccgctggatcatgcaggacgaccgtttcgacggcattccgctgatcctcgaaaccatcaacccggatatctgggcagaagagatcgcctggctgaaagcgcaacaaactgaaaaagcggtagcctgaagatgaataaccgggaaaaggagatccttgcaattttacggcgtaacccgctgattcagcagaacgaaattgcggacatgctgcaaatcagccgttcgcgcgttgcggcgcatattatggatttaatgcgcaaaggccggattaaaggcaaaggttacattctcaccgagcaggaatactgcgtagtggtggggacaatcaatatggatattcgcgggatggcggatatccgttacccgcaatcggcttctcatcccggtacaattcattgctcagcgggcggcgtgggacgcaacatcgcccacaatctggcgctgttaggccgtgacgtccatttgctttcagtgattggcgatgacttttatggcgaaatgctcctggaagaaacgcgccgtgccggcgtgaatgtctccggctgcgttcgtttgcatggtcaaagcacatcgacgtatctggcaattgccaatcgagacgatcaaaccgtgctggcgattaacgatacccatctgctggaacagttgacaccgcaactactgaacgggtcgcgcgatttacttcgtcatgcgggcgtggtactggctgattgcaacctgacagccgaggcgctggaatgggtctttaccctcgctgatgaaatcccggtgtttgtcgataccgtttcagaattcaaagcgggcaaaatcaaacactggctggcgcatattcacaccctgaaacccactttaccggagctggaaattttatggggacaggcgatcaccagcgatgctgaccgtaataccgcagtgaatgcattgcatcagcaaggtgttcagcaactgtttgtttatttgcccgatgagtcagtttattgcagcgaaaaggatggagaacaatttttgctgaccgcgccagcgcatacgacagtagacagttttggtgctgacgatggttttatggcgggcctggtatatagctttcttgaaggatacagtttccgcgacagcgcccgttttgcggtagcctgcgcggcaatttcgcgcgccagcggcagcttaaacaaccctaccctgtctgccgataacgcgctttcattagtgccaatggtgtaacaatgttgccggatgcgacgcttaacgcgtcttatccggcctacaaatcaggcaatttcagcaagtaaatgtaggcctgataagcttgcgcatcaggcaatgacactcaagctaaaccaataaagaacccggcaatggtcgcactcatcaagttggaaagcgtcgccgccgccagcgcccgtaaaccaagctgggcgatttccggcgcacggtgtggcgcaaccgcagaaaacgcccccaccaccaccccgatagaaccaaagttagcgaaaccgcacaacgcgaaggaaataatcgccacagttttagcatcgagagtgccagccgtttgcagatagggtgagaaattgagataagcgacaaattcatttattgccagtttctgtccaatcaaactcccggcaagattcgcatcactccagtccacacccatcacccacgccagtggagccagcaggtaacctaaaatggactccagcgaggcatgttcaaaaccaaaccagccaccaacgccgccgataataccgttaatcaacgcaattattgcaacaaatgccatcaccactgttgccacacctgcggcgattttcagcccggtcattgcccctgtcgcagcggcttcaataatgctttttggcggtgtttcggtgaaagagaggttattaaaggaaacctgcgaagattccgttgccgggcttaacaggcgggcaaacaagatcccgccagggatcgccattaatgatgccgccagcagatattccacaggcacgcccagtgcggcgtaaccaatcattgtcgaaccagcaatcgaggccatgccactacaaatcgctgtaaataattcattgcgattcagacgatcgataaagggtttgacgattgccggaatttcgttttgcccgaggaaaatggtggtgaccgcgacgaatgactcgatcttgctgatatttaatgctttctggaagataccgccgagaattcgaattaaaatccccatcacaccgatgtagtagagaatactcaccagcgcggtgacgaagataattgccggtaacaccctgaaaccaaagataaatcctgcaccatcaaataaggtatccattttcggtccgaccagagaaccgaagataaatgcgctacccgcgtcgctgtacgccatcactttatgcacgccaaaagcgactttttcagcgacccaacgccctggcggtaaccaaagcataatgccgccaatcacgacctgtaacactaacgccgcgccaacggtacgcaggctgatcttcttcttgtttactgacagtaaaaacgcaatcgtcagcaataccaccattcccagaacacttctcatgacatccatagtgattatctcttcatgtcatattgggcgacggctttctgcccatcagaaatagccaggcctgcatcttgcgataccggcccggcttgttatcaacacttaatgggttttgatgtagccgcgcacgcactcttcgactaatccccagaaccagtctgtatcaatagtgatgccgactttggtattggcgggcttgccaagaacgcccagctcgtcgcagacggtacgcccatagcaagggccactgttgacgtccacttcgacgtacatctcctgggttttaatgccatcagggttaatcagataaccgatgcaggtggcgtcgtgcaccgggccgccagcaaggccgtagttttcgaactgcgttttgagagtgaagttcatgatgtcgctgaacagctctccggcggggccgcctgccctttccatccgagcaatcacgtccggggtgcaaacggtctggttggtgagatcgaggcccatcatcactaatggaacgccggaggtgaacactacgcgtgcggcttccgggtcggcaaagatgttgaactcggcagatggcgtgaagttgcctgtaccgtaagcgccgcccattagcacaatttcacggattttgggcaggatcgcgggttgcatacgcattgccaccgcgatatttgaaagcggaccaaccggcaccagagtgatatcgccatcgcttgccatcagggtatcaatgatatatttcaccgcatgagtgctttctgcctggcgggtcagcggctcgaataccgggccatccagtccggtttcaccgtgaatattatcggcaacgatttgttgacgcataatgggctgcggcatccccgcataaaccggaacattaatctccagtttctggcaaacattcaggccattaattaatgttttatcaagcgtctgattacccgctacaatagtgatgcctaataaatctattgccggatgtttcgccgccatcattatagcaatagcatcatcatgacccggatcacaatccagaataatttttctcttttccattgtttatttcctctgtttccagttgcgttattttttctacagcaaagaaaattcgaccgggccgatgattgaatcttaacaacagcgtacgtatgctaaatatgagaaatctcatagcggataaacatcgtgaaagaaatccacaataatgatcttaagcagcaattgatgagtgaatccgcgtttaaggattgctttttaacggatgtttcagccgatacgcggctgtttcattttttagcgcgtgactacattgtgcaggaagggcaacagccgtcctggctgttttacctgacgcgaggccgcgccaggctttacgccacgctagctaatggtcgcgtgtcgctgatcgatttctttgccgccccctgttttattggcgagattgagttaatcgataaagaccatgaaccgcgtgcggtgcaggctattgaagagtgttggtgccttgcgctccctatgaaacattaccgtccgctgttattaaacgacacgctatttttacgaaaactctgcgtcaccttaagtcataaaaattatcgtaatattgtttctttaactcagaatcaatcatttccgttagtgaatcgcctggcagcatttatattactctcgcaggaaggtgatctttatcacgaaaagcatacgcaagcggcagagtatttaggcgtttcttatcgacatcttttatatgttctcgcgcagttcattcacgacggtttattaattaaaagcaagaaagggtatctcattaaaaacagaaagcagttgtcaggactggcgctggagatggacccggagaataaattctccgggatgatgcagtaaaaattattttcaatagcgcgattgccggatgcaacgcttaatacgttttatccggtctacaaatcgagcattacgccagaccaataaagaacccggcaatagtcgcactcatcaggttggaaagcgttgctgctgccagcgcccgtaaaccaagctgggcgatttccggcgcgcgttttggcgaaatagccgaaaatgcgccaacgacaacaccgatagaaccaaagttagcaaaaccacaaagcgcaaaggagataatcgcaatggttttcacttccagcgtgccgcccgtttgcaggtatggggagaaactcaggtaagcgacgaattcgttaatcgccagtttctgcccaatcaggctacccgcaagattggcatcactccagtccacacccatgatccacgccagcggtgccagcacatagccaaaaatactttccagagaggcattggcgaaaccaaaccagccgccaattccgccgataatgccgttgatcagcgcaataattgcgacaaacgccattaccaccgtcgccacaccagcggcgatttttagcccggtcatcgcaccgctcgccgccgcttcgataaagctttttggcggcgtttcgctgaacgacagattttcaaatgtgacctgcgaaggctcggttgccgggctaagaatacgtgcaaacaaaatcccgccagggatcgccatcagcgatgccgctaacaggtagtcaattggtacgcccattccggcataaccaatcatcatcgaaccagcaatggacgccatcccgctacaaattgcggtaaacaactcgttgcgattcatgcgatcgataaacggtttaacgatcgccgggatctcattttgcccgaggaaaatagtagtaaccgcaacaaaagattcgattttgctgatgttgagggctttctggaaaatgctgccaaggatgcgaatcagcagccccatcacgccaatgtagtacagcagactgatgagcgcagtaacgaaaataatcgccggaagtacgcgaaaggcgaagataaaacccgcaccgtcaaacaggacatccattttcggcccaaccagcgaaccaaaaatgaaggcgctaccggcatcactgtaagacatcactttatgaacgcctaatgccgcctgttctactgcccattttcccggtgggaagtagagcatgatgccaccaatagcgatttgcagcagcagtgcggctccaaccgtgcgcaaactgatgctctttttattcactgacaacagaaatgctattgccagtaacaccaccatccccacaacacttctcattatatccataatgattttcccttcatgccggtaaacccggcgtcagcgccaggttttggtatgcttgatgagtacgggcgacggctttctgcccgtcagaaattaacccgcgagacgctgatattctttggcaatttcgctcgccagaatggcgttgttgaacaccagctggatgttggatttcaggctgtcaccgccggtcagttcagcaacgcgcgccagcaggaatggcgtactttctttaccaatgactccctgagcttcagcttcagctaccgcctgatcgatcgccgcattgatagtgtgttccggcatagcaaactgttccgggatcgggttcgctaccacgaggccaccgttcagaccgctttgccatttcaccaccattgcacgggcaatttcgctggcgctgtcgagacgaatgctgacgtcaaacgggctggtgcggcagaaaaacgcaggcagcgctttagtctgatagccaattaacggcacaccgaaggtttctaaatactcagtggttaatcctaaatcgagaatagatttcgccccggcacaaacaacggtgacattagtatttgccagttcttgcaaatcggcagaaatatcgaaggtatgttccgccccgcgatgcacaccaccaattcccccggtggcaaatactttaattccggcaagcgccgcaataatcatcgttgaagccacagtggttgcgccattttttccggcggcaacaacaaaaggtaaatcgcgacgactaactttggtcacgttatgcccttcacgacccagtaattcaatttcttctttgcttaaccccactttcatcacgccgccaataatggcgatcgtggcaggtacagcgccctgtttacgaatagtttcttcaacttcaattgcggtctgggcattttgtgggaacggcatcccgtgagaaataatggtcgattccagcgccacaaccggttttttgttttttaaagcgtcctgcacttccggggaaatttgtaataattcaggggaaatttttaattcagacattctgcgttctccactaacgatataacgttggcaatcgataaatcggggttattggtgtattcacaggagagcgccattgacgaacatccctgtgcgaaacgaacagattcggcaaacggcattccgtctacccaacacgaagcaagtcccgccatcatggcatcgcccgctccggtaacattaataacattggttttgatcggcgcagaccagccactttcaccgctgatatcgctgtaataaacgccgtcgccgcccatgctcaataccagtcggttcaggccatgttgatggaaccaggcagcaacttttgccacatcttcacgccctgacagcgcaatcccactcagggtttccgcttcaaggcggtttggcttgagagtgtggatctgatttagacggtcgcgcactttgacacatttccatgccgaaaccggatcgacaaatacgggtacgttggcggcattatccagaatccatgccagtgcctcttcactgatattacagtccgcgacaatgacctttgccctctgaataaattcaccgtgctgtgcgagatattcagctgtaatagcgttgctaatattcatgtcatttatagcaaccagcatttcaccggtattatcgagtaatgataaataactcgacgtattttctcccggcacaatcaggcatttatcgacataaacgccagattgattggtttgcgttagcagcgattgaccataaaaatcactgcctacggcgctcagtagccaggctttgttacccagcaacgccaggttttgtgcaatattgcgccctactccaccaggcgtaaattttattttacctggatttgaatccgcataatttaatgattcatgtgaatatccggcgacatcaatattcgccgaacctataattacgacataatccttttcgcgcatagcacgtcctctggtaaaaaattaccaaccctgtcaatccacaagaatatagatactgcaaagacggtttaaacatgtgttcatatttaaacatgtgctcatagtatgcatgttttacgtaaagtaaattaccgccagagaggcaaaatgggcagatttgagcaggctcacaaaatgcgattaaatgcctgaattacaaaagcgaggaatttgtgacgggatgcacagaacagaacaataaaaaagggcagaaaataatctgcccttgaggaaataacctgagtgtttgatgaacgtttgaagtttctactgaaagataaaaccatttaaattcataaaattacattcacaaaccggtcattctctttgcgctcatcaaatgttacaggacaggaaatttctgccctgtaacacaccttttattacgctgctttcgctactgcgtccacttccggacgtttcaggaaggcataggccaaacccgccaccagcgtaccggcaataattgctaccaggtaacccaataccggcgtaatagcgccagggatcagcagaacaaacagaccaccgtgcggtgccatcagtttcgcaccaatcgccattgagattgcgccagtcagcgccccacccacgatacagcacggcagcacacgcatcggatcacgagcagcaaacggaattgcaccttccgaaatgaagcacagtcccaataccagagcggctttgccaccttcctgctgcgctttgtcgaatttgcgacgcgccaccattgttgccagacccattgccagcggtggcaccatacctgccgccataatcgccgccatcgggccataggtttgagtactcagcagacccacaccgaatgcgtacgctgctttgtttaccggaccgcccatgtcagtacacatcatgccaccgaggatcgcccccagcagaaccgcattcgcagtccccatggtctgcagccagtgagtcagcccttcgagaatgccagcaactggtttaccgatcaggtagatcatcgccagaccgaccaccagactggaaattagcggaatgatcaggatcggtttcagcgcctccatactctgtggcagtttcaattgcgtactgattaacttcgcaatgtaaccagccaggaagcccgcaataataccaccaatgaagccagaaccggtgctgaccgccagcataccgccaatcagacccggagtgaggcccggacgatcggcaatggaaaaggcaatataacctgccagtaccggcaccatcagcgcaaaggctgaaccaccaccaatctgcatcagcgccgcagccaacgtacccggctctttaaacgcttcgataccaaaagcaaaagaaagcgcgatacacagaccacctgcaacgaccatcggcagcatgtaagaaacgcccgtcagcaagtgacggtatgcgcctgcactctctttcttactttcagtggtcgccgtttgagctttgcccgccggttcatacggcgttgcttcagcaaccgctttatccagttcctgcgcggttttcttcagcgccagaccggtagaggtacgatacatcggtttaccagcaaatttcgccagatccacttcgatatctgccgccacaatcaccagatccgctgctgcgacttcttcgggagtgattgcattacccgcgccaacagaaccacgggtttcaactttcacccaccagccacgttttttcgcttcggtttcaatggcttcagccgccataaaggtgtgtgctacgccagtcgggcaagcagtcaccgcaactacgcgtttcggaccgctggcggcaactggtgctgtcgcagcgaccggcgcagtgtaaggtttcgcatggcctttggcttcactcaggaacagctcagggtgcgcaactgcccgggaaatatcgcccagccagacatttttaccgttcagcgcgctgtcgttcgggatggaatcaccgagaacaatcgccatttcagcgtcgttcggattgtcgatgatttccagttttgcttttcgcgccgccgcgcccagcagggtcttcgccatataggcgcgtgcctgaccgagattagcgtcaataatcagcagcgttttcattatgcctctcctgctgtcagttaaaaggttgtaagtcgacgcgcgccatcattgcggccaactgcggacgatcggtaatacccacattgctttgacttaccgccagggctgcaacagctgtcgccagacgcagtgtgtgttcactggattcacgcatcagcaagccataaatcaggccaccaaccatagaatcccctgcgccaacggtgcttacgacatcgactgacggtggtttggcgatccattcgccggaggcattaacccaaagcgcgccttcggcacccagtgaaataacaacatgcgcgatgccttgttcacgtagcgcatgtgcagcttcaatcacatctttcatttcaggcagtttacggcctgcccagatttccagctcgcggcggttaggtttcaccagccacggtgccgctttcaaacctgctactaacgcttcacggctactatcaaagataatgcaaggacactgactacgcaggcgagtcatccagtcggtgaacgcttccgggctgacgcctgacggtaagcttccgctgacacagaccatatcgaactgaccgagccagctcagagaatcagtcacaaagcgttcccagtcggcgggggtgacttcaaaacccgagaagttgaagtcggtcacttcgccgtctttttccgtcagcttaacgttaattcgggtgcgcccctgtacaacctggaaacggttggcaatgcccagctcgctgaacagttgctgaaaaccatcctgattgtctttacccaggaagccgccaacggtgacatcaattcccaggtcttttaatactttggccacgttgatgcctttacccgccgcatgcagaccggtggttttcaccaggttcacttcgccgcgttcaatttccgggcagaaaccaacaaggtcataagccggattaagggtgatagtagcaacacgtctgctcattatgcgccctccccaagaccagcagcgatagcgtcgccgattgctttcagcgcctgttcagcatctgcaccctgggcggtaaagcgtaggcgatgacctttcttaacgccaagtgccacaactttcatcagactacgtccgtttgccggtttgccggtaccatcaaggtttgtcacggtaatatcactgttaaattgtttaatggtattgaccagcatggtacctggacgagcatgcaggccgtgttcattgcgcaccacaaactccgcgcttaacacgtcgtcggtcggcgcatcatcgctggtcagcagcgccagcaacgttgccgcatccgctttcagcaagcggtcagctttattgtcgagcaataaatcagcgagacgcttaagaaccgcgatgggctgatcgtcattcatcgccacactcaccagcatggctgccgtttcgccgtccacatcaaaagcatttgccgcacggcttaccgcaatcgcgctacgcagattgccttcggcgctatcgctcagccagataccctgtccgagattcagcggttgttcattgatggctttggtgacgaaagtggcgtcaactgcccccgcctctttcagacgcgcagcgttcagcgcctgaagagtcagcagatcgctggcgacgatatccagtgtcagcatttcgttgtcgagcttcagctgctcactctgcttttcgcccatcagtaatgcgcgaagttcttctgctgttgttgctgacttcagttgttcagcaacggaatcatcgctcagtacgtgggtcagctggcgtagcaggcccagatgttcatccgagctggcagcaataccgattgccacgtacgctacctgaccgtcaccccaggtgacgccttccgggaactgaaatacctgaacgccggttttcagcacctgatcgcgggtgtcggtagtgccgtgtggaatagcaataccattgccgaggaacgttgaggtttgctgttcgcgcgccagcatgccattgacgtagccttctgctacattaccggcctgcaccagcgccgcagcgacctggcgaatcgcctcttctttgtctccggccttttcgcccggatggatgtcctgtacggataactggaacatagttctcctctcttgctgaattgaaacgattcagcctctatgagaaaaaaagcgccaacctggcttagggttaaagacaagatcgcgctgaaacgtttcaagaaagcataatacttctgtttcagcacgcaaggaaagccgtaaagttatgagcaaaagtttgatgtgctgcacaattttttgccatttttcctaattgctgatgggaaaatccgttatcagcaatttcatttcagcagcgtcagcagccaatcagcaacagtgaaatggcattttgactattcgtggcgcttttgatttcgctgtctgtttattttctgacaagcagcgtaaactccgcgtcttcctcttccagtgatcgaccagcatgcataactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattgggattctggtaagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggtgtgatggtgtggctgtttttaccgtcgatgcgaaaagagcttccgctggcgaccggcacgatcgaagcgccgcgccgtaaccgtcgcgatacgctgctgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatctgatgcccggtcaggcgggttcagccaccacgctctataccaacacttcgcgcgtgggctggatcatcgcaggatcagtggcgggcatcgtcgccgagatctggaattatcacgctgtgttctggtttgcgatggtgatgattatcgccactctgttttgcttactgcggattaaagatgtttaaggcgcggtcagcatttccagatcgataagccaggtcatggcctgctgacgcgagttaccgcacatttcagcgctggcttgtaagcctgcacagactttcggtcgcagtggcgaggtgaaaattttacagcgttgctgttcatcaagctgaatgcagggcgtattggcgggcttgccatctggcataccgggaatagggctggaaattgaaggggcagtgcaacacgccccgcaacccggacggcattccatacgttgttctcttaaggttaaccaccggattgatgagcgcgcacagtaccaccttttttgcaccagcaaaagtgcgaataccacttgcccgaaaggcccgtcgcgagtactttgtcgcgatatttttgacattttcgactacaggaatttttcgatgccaagagcgaacgaaattaaaaaaggtatggtactgaattacaacggcaaactgctgctggttaaggatattgatattcagtcgcccactgcccgcggtgccgctacgctgtacaaaatgcgtttttctgatgtccgtaccgggctgaaagtagaagagcgtttcaaaggtgatgatatcgttgacaccgtgacgctgacccgccgttacgttgacttctcctatgtcgatggcaacgaatatgtctttatggataaagaagactataccccgtataccttcaccaaagatcagattgaagaagagttgctgtttatgccagagggcggcatgccggacatgcaggtgctgacctgggacggtcaactgctggcgcttgagctgccgcagaccgttgatctggaaatcgttgaaaccgcaccaggcatcaaaggggcatctgccagcgcccgtaacaaaccggcgacattgagcactggtctggtgattcaggtaccagaatacttaagcccgggcgaaaaaattcgtatccatatcgaagaacgccgttatatggggcgtgctgactaacttcagccgcatgcagaaaagggatagctcaggctgtcccttttttaatttattataccaatcttctattttgcgcttcctgaacaccttacgccctcaattttcactcgttgattgatcgccctcacacttcatcgcattaacaatccagaccaatttcaattgctgtcatataactttacactgtcgttgttaattaatcgttactaagacgtgactcctatgaatacaatcgcctccgttacgctcccgcatcatgtacacgctccacgctatgatcgccagcagttgcaatcacgtatcgttcattttggctttggagcctttcaccgcgctcatcaggcgttactgaccgatcgtgtgctgaatgcccagggcggcgactgggggatctgtgaaatcagcttgttcagcggtgatcaactgatgagccagctccgcgcacagaaccatttatataccgtgctggagaaaggtgcggacggcaatcaggtgataattgtcggtgccgttcacgaatgccttaatgcaaaactggattccttagcggcaattattgagaaattttgcgagccacaggtggcaattgtttccctgacgattaccgaaaaaggctattgtattgacccggccaccggtgcactcgacaccagtaatccgcggattattcacgatctacaaacccctgaagaacctcactccgcaccgggtattctcgtcgaagcactgaaacgccgccgtgagcgcggccttacaccgtttaccgtgctctcctgcgacaatattcccgacaatggtcatgtggtgaaaaacgcggtgctgggaatggcagaaaaacgttcgccagaactcgccgggtggataaaagagcacgtcagttttccgggaaccatggtcgaccgcattgttccggctgcaaccgacgaatcactggtggaaatcagccagcatctgggggtgaatgatccctgcgcgattagctgcgaaccgtttatccagtgggtggtggaagataacttcgtcgctgggcgtcctgcctgggaagtcgcaggtgtacaaatggtgaatgatgtcctgccatgggaagagatgaaactgcggatgcttaatggcagccactcttttctcgcttatctgggttacctctcaggattcgcccatatcagtgattgcatgcaggatcgcgcatttcgccatgccgccagaacattaatgctggatgagcaagcgccgacactgcaaattaaagatgtcgatttaacacaatatgcggataagttaattgcacgttttgctaatccggcgctgaaacataagacctggcaaatcgcgatggatggcagccagaaattaccgcaacgcatgctggcaggtattcgcatacatcaggggcgcgaaacggactggtcgttgctggcattaggcgttgcaggctggatgcgttacgtcagcggcgttgatgatgccggaaatgccattgatgttcgcgatccgcttagcgataaaattcgcgaacttgttgcgggcagcagcagtgaacaacgcgtaaccgccctgctttccctgcgtgaagttttcggtgatgatctgccagataacccgcattttgtgcaggccatcgaacaagcctggcaacaaatcgtacaattcggcgcacatcaggcgctattaaacaccctcaaaatttaacgatttctgcggttaaagcggatgaagctcaccttcgtccgctctccccttctcttttctgccttttttagccaggattaacgctcagttaacttaccagagtattgcggagccgttgtgaccaggaccaacctcatcaccggttttctcggcagcgggaaaaccacgtcgattcttcatctgttagcccataaagatcccaacgaaaaatgggcggtactggttaatgaatttggggaagtcggaattgatggtgctttgctcgccgatagcggcgcattgctgaaagagatccccggcggctgcatgtgctgcgttaatggtttacccatgcaggtagggttgaataccttactgcgtcagggaaaaccagaccgcttgttgatagagccgaccgggctgggccatccgaaacagatcctcgatctgttaaccgcaccagtctatgaaccgtggatagatctgcgcgccaccttgtgcattctcgatccgcgcttgctgctggacgaaaaaagcgccagcaatgaaaacttccgtgaccagctggctgccgcagacatcattgtcgccaataaatccgaccgtacgacgcccgaaagtgagcaagcgctacagcgttggtggcagcaaaatggtggcgatcgacaattaattcacagtgagcatgggaaagttgacggtcatcttctggatttgccgcgtcgcaatttagccgagttgcccgccagcgccgcgcattctcatcagcatgtcgtgaaaaaagggttagcagcgttaagcctgccagagcatcaacgctggcgtcgcagtctgaacagcgggcaaggatatcaggcctgcggctggatattcgacgctgatacggtattcgacaccattggcattctggaatgggcgcgacttgcaccggtggaacgcgtcaaaggcgtgctgcgtattcccgaagggctggtgcgaatcaaccgtcagggcgatgacctgcacattgaaacgcaaaacgttgcgccaccggacagccgtattgagctgatttccagcagcgaagctgactggaatgccttgcagagcgcgctgttgaagcttcgtttagcgactaccgcgtaaggttgcctgcgtttttcagtaagataattagagaaaatatgattaaaaatttgccgcaaatagtgttgttgaatattgtcggcctcgcgctgtttctttcctggtatatccccgttaatcatggattctggttgccgattgatgcggatattttttatttctttaatcagaaactggtcgaaagtaaggcctttttgtggctggttgcattgaccaacaatcgcgccttcgacggttgttcactgctggcgatgggtatgttgatgctgagtttctggctgaaagaaaacgcccctggcagacgacgtatcgtgattattggtctggtcatgctattaactgcagtggtattaaaccagctgggtcaggcattaattcctgtaaaacgggccagcccaacattgacttttaccgatattaaccgcgtcagcgaactgctctctgttcccacgaaagatgcctcacgagatagctttcccggcgatcacggcatgatgctgcttattttttcggcattcatgtggcgttatttcggcaaagttgcaggccttatcgcccttattatttttgtggtttttgcatttcccagagtaatgattggcgcacactggtttactgacatcattgtcggttcgatgaccgtgatattgatcggtttgccctgggtgttgctgacgccattaagtgatcgattaatcaccttttttgacaaatcactaccaggaaaaaacaaacatttccaaaacaaataactcacagtaattaacatcatcagggttatttttatagtgaggataatcctgatgatgcgcaccgtgctttcatctatcgaacgcaaaaatcattctctaagtaaatgaatggattgcatgcgtttcactcaattgtactttaattgaccaaccccgcttattaactttctgtatcactttttcttataaaaaatcatgtaaaaccgctcgccaagaccgcaccaatcgggtaatctcgaactcgttttgcctcggcggtagattatcctcacagcatataattttgtgcgttagtccacagatttggccttaaggaattgtttcaacatgcccaggtaattagtctcgtgtcgcttggcatttttttataacgatatttgtcgttaaggacttcaagggaaaacaaacaacatggtcaaatctcaaccgattttgagatatatcttgcgcgggattcccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgactggaaaggcgtacgttatcgtctgggcggcagcactaaaaaaggtatcgattgttctggtttcgtacagcgtacattccgtgagcaatttggcttagaacttccgcgttcgacttacgaacagcaggaaatgggtaaatctgtttcccgcagtaatttgcgtacgggtgatttagttctgttccgtgccggttcaacgggacgccatgtcggtatttatatcggcaacaatcagtttgtccatgcttccaccagcagtggtgttattatttccagcatgaatgaaccgtactggaagaagcgttacaacgaagcacgccgggttctcagccgcagctaataaaccgtttggatgcaatcccttggctatcctgacgagttaactgaaagcactgcttaggcagtgcttttttgttttcattcatcagagaaaatgatgtttccgcgtcttgatccaggctatagtccggtcattgttatcttttaaatgttgtcgtaatttcaggaaattaacggaatcatgttcatacgcgctcccaattttggacgtaagctcctgcttacctgcattgttgcaggcgtaatgattgcgatactggtgagttgccttcagtttttagtggcctggcataagcacgaagtcaaatacgacacactgattaccgacgtacaaaagtatctcgatacctattttgccgacctgaaatccactactgaccggctccagccgctgaccttagatacctgccagcaagctaaccccgaactgaccgcccgcgcagcgtttagcatgaatgtccgaacgtttgtgctggtgaaagataaaaaaacattctgttcatctgcgaccggtgagatggacattccactcaatgaattgattccggcgctcgacattaataaaaacgtcgatatggcgatcttacccggcacgccgatggtgccgaacaaacccgcaatcgtcatctggtatcgcaaccctttgctgaaaaatagcggcgtctttgccgctctgaatctcaacctgacgccttcactcttttatagttcacggcaggaagattacgatggcgtcgccctcattattggcaatactgcgctatctaccttttcttcacgtttgatgaacgttaacgaattaaccgacatgccagtccgtgaaactaaaattgcgggcattcctctgaccgttcggctttatgcagatgactggacatggaacgatgtgtggtacgcatttttactgggcggcatgagtggaactgtcgttggcctgctctgctattacctgatgagcgtacgtatgcgccccggcagagaaatcatgaccgccatcaagcgcgaacaattttacgtggcgtatcaaccggtggtggatacacaagctttgcgagtaacgggcctggaagtactgctacgctggcggcatcctgtcgcgggagaaattcccccggatgccttcattaactttgccgaatcgcaaaagatgattgtgccgctgactcagcacctgtttgagttaattgcccgcgatgccgcagaattagaaaaagtgctgccggtaggcgtcaaatttggtattaacattgcgccggaccatctgcacagcgaaagctttaaagcagatatccagaaactgctcacttccctgcccgcacaccatttccagattgtgctggaaattaccgagcgcgatatgttgaaagagcaagaagccacacaactcttcgcctggctgcactcggtcggcgtagaaattgctattgatgacttcggcaccgggcacagcgcgcttatctatcttgagcgttttacgctcgattatctgaaaattgaccgtggatttatcaacgccatcggtacggaaacgatcacttcccccgtacttgacgcggtgctgacgctggcgaaacgcctcaatatgctgacggttgctgaaggggtcgaaacgccggaacaggcgcgatggctaagcgaacgcggcgttaatttcatgcaaggctactggattagccgcccgttaccgctggacgattttgttcgctggctaaagaaaccgtatacgccgcagtggtaaggtgtgcttacgtcccttattattcatagtgaaagcatgccggattgcggctaatgatgagtaaaaggaaatccgttgcagatgattgtgcgcatactgctgctgtttatcgctctgttcacctttggtgtgcaggcgcaggctatcaaggaaagctatgcctttgccgtgctgggcgaaccccggtacgcgtttaatttcaaccattttgattatgtgaaccccgccgcgccaaaaggtgggcagataacgttgtcagccctcggcaccttcgataatttcaaccgctatgcactgcgcggcaacccgggcgcacgcaccgagcagctgtacgacacgctatttacgacttccgatgacgaaccaggcagttattacccgctgattgctgaaagcgcacgctatgctgacgattattcctgggtggaggtcgctattaatccgcgcgcccgttttcatgatggttcgcccattactgcccgcgatgtagagtttacttttcaaaaatttatgaccgaaggcgtgccgcaatttcgtctggtctacaaaggcaccaccgtcaaagccattgcaccgttaaccgtgcgcattgagttagctaaacccggcaaagaagatatgctgagtctgttttcgctgccggtatttccagaaaagtactggaaggatcacaaacttagcgacccgctcgccacgcctccgcttgccagtggtccgtaccgcgttacgtcctggaaaatggggcaaaatattgtctattcccgtgtgaaagattactgggcagcaaacttaccggtaaaccgtggacgctggaatttcgacaccattcgctacgattattacctcgatgataatgtcgcctttgaagcgtttaaagcaggtgcctttgatttgcgtatggaaaacgacgccaaaaactgggccacgcgttataccggtaaaaatttcgataaaaaatacatcatcaaagatgagcaaaagaacgaatcagcccaggatacgcgttggctggcgtttaatatccaacgtccggtattcagcgatcgccgggtccgggaagctatcactctcgcctttgactttgaatggatgaacaaggcgttgttttacaatgcctggagtcgcacgaacagttattttcagaataccgaatacgcggccagaaattaccccgacgccgcggagctggtgcttctggcaccaatgaaaaaagatctaccgtcagaagtcttcacacaaatctaccagccgccggtatccaaaggcgatggctacgatcgtgacaacctgttaaaagccgacaaacttctcaacgaagcgggctgggtgctgaagggtcagcaacgcgttaatgccacaacgggtcagccactcagctttgaattattgcttcccgcaagcagcaatagtcagtgggtattgccgttccagcacagcctgcaacggctgggtatcaacatggacattcgcaaggtggataactcgcaaatcactaaccgcatgcgcagtcgcgactatgacatgatgccgcgcgtatggcgggcgatgccgtggcccagttccgatttacagatttcctggtcatcggaatatatcaattccacttataatgcccccggcgtgcaaagcccggttatcgactcgctgatcaaccaaattattgccgcgcagggaaataaagaaaaattactgccgttggggcgagcactggatcgcgtattaacgtggaattattacatgctgccaatgtggtacatggcggaagaccgtctcgcctggtgggataaattctcccagccggccgtgcgccccatctatagcctcggtatcgatacctggtggtatgacgtcaataaagcggccaaactgccgtccgccagcaaacagggagagtagatgggcgcttacctgattcgccgtctgttgctggtgatcccaacattatgggcgattatcaccatcaactttttcatcgtgcaaattgcgcctggcggtccggtcgaccaggccatcgccgccattgagtttggtaatgccggagtattacccggcgcaggcggtgaaggtgttcgtgccagccatgcgcaaacgggtgtcggcaatatcagcgacagtaattaccgtggcggacgcggattagatccagaagtgatcgctgagatcactcatcgctacggttttgataagccgatccacgaacgttacttcaaaatgctctgggactacatccgctttgattttggcgatagcctgtttcgcagcgcctcggtgctgacgctgattaaagacagtctgccggtttccatcaccctcggattgtggagcacgctgattatctatctggtgtcgattccgttaggcattcgcaaagctgtttataatgggagccgctttgacgtctggagtagcgcatttatcatcatcggctacgccattccggcctttttgtttgccatcctgctgattgtcttcttcgcgggcggcagctatttcgacctgttccctctacgcggcctggtttccgctaactttgattcgctgccgtggtatcagaaaatcaccgattatctgtggcatatcacgctgccggtgctggcgacagtgattggtggctttgcggcgctgaccatgctgacaaaaaactcattccttgatgaagtgcgcaagcaatacgtggtgaccgcgcgtgcgaaaggggtaagtgaaaaaaatattctctggaaacatgtgttccgcaacgccatgctgctggtgattgccggttttccggcgacgtttatcagcatgttttttaccggctcgctgctgattgaggtgatgttttcactcaatggtctgggcttactgggctacgaagcgaccgtctcgcgcgattatcctgtaatgtttggtaccttgtatattttcaccctgattggcctgctgctgaatattgtcagtgatatcagctatacgctggttgatccgcgtattgattttgagggacgttaatgtcgcgactcagccccgtcaatcaggcccgttgggcgcgttttcgtcataaccgtcgcggctactggtcgttatggattttcctcgtcttgtttggtttgagtttgtgttctgaacttatcgccaacgataaaccgttgctggtgcgttatgacggcagttggtatttcccgttattgaaaaactacagcgaaagcgattttggcggcccgctggcaagtcaggctgattatcaggacccgtggctgaaacaacggctggaaaataacggctgggtactgtgggcaccgattcgctttggtgctaccagtatcaactttgctaccaataagcccttcccttctccaccctcccggcaaaactggctgggaacggatgccaacggcggcgatgtgctggcacgcattctctatggcacgcggatctcggttctgtttggcctgatgctgactctctgttccagcgtgatgggcgtgctggcgggggcgctacaaggctattacggcggtaaagtcgatctctggggacaacgctttattgaagtatggtcggggatgccgacgctgtttttgattattttactttccagcgtcgtacagcctaacttctggtggctgctggcaattactgtcttgtttggctggatgagtctggtcggcgtggtgcgggcggagtttttacgtactcgtaatttcgactacattcgtgcggcacaggcgcttggcgtcagcgatcgcagtatcatcctgcgtcatatgttgcctaatgccatggtcgcgaccctcacctttttaccgtttattttatgtagttcgataaccaccctgacctcgctcgatttcctcggcttcggtctaccgctcggttcaccgtcactcggtgaactgctgttacaagggaaaaataaccttcaggccccgtggcttgggatcaccgccttcttgtcggtggcgatattattgtctttgctgatctttattggtgaagccgtccgcgacgcatttgatcctaataaggcggtgtagcatgacgcaaactctgttagcgattgaaaatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcacgccagcgatcaaacgttgcgcggtgtacgcggtaataagatcgccatgatttttcaggaaccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacggcagcgggtgatgattgcgatggcgctgttaacgcgaccggaattattaattgccgatgaaccgaccaccgcactggacgtctctgtccaggcgcagattttacagctgttgcgcgaactgcaaggcgagctgaatatgggcatgctgtttattactcataacctcagcattgtcagaaaactggcccaccgcgtggcggtaatgcaaaacggtcgctgtgtcgagcaaaattacgccgctacgctatttgcatcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagtacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcacaacgcgaacaacaagtgatagccgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcatactgcgacaaggggaagtagtggaacaaggaccgtgcgcgcgcgtgtttgccacaccgcagcaggagtatacgcgtcagctactggcgttgagctgacgcttaaaaaggattgtagtttgaaaagggttcggcaattgccacaccaaaatttttcaatcggcatgttgcagcaaactcgtcctggcgatttacaaacaggcacggctcaccttcacactccagcaccgaacatggaacttcgatgtcgcttaacgcctggcttagtttatacatcaccgaccatgcattatcaccatccgggctaagcaatttaagcgccaccaggctgttgtcaccgcacggtccattttgcggaatcggttcaaccttcgaacctgcgaaaccagcagaccagcgatagttctgcggcagtcgatggacgattgagagttgtaatgaagtcacttattttccccggaagcacattcacttcacaatttgtttacatcaattttaacacatcatcaacaatccgtctttatacagatcgtaaagattgatgcctcgcctgcgtggcctctatggctctgatttaagtaatatctgcgggcgtggtcacgtttgcggggctatatgtacccgtttctgcgatctaactcaacctttttaactacaatgatgtgactttttacataaattgattttacataaaataaacatatatcgggggaatgatagatttgtggttgacatgcatcaacaaaggaagccttttagcttcctcgttgtgcaatagatcaccgttttttcggccgactggcgtacagacagaagagaatggagctggttgcgcagaatgcaattgaccaaatcatcggccatgcagagttaaaggtcgcaagagaaagcaatgcgccaacaattgcccctatgccaaaacggaaggttcctgccagcgaagatgccgttcccgccatatggggaaactcatcaagaatgaccgccatcgcattggatgacaccatcgacacgcagcccacaaacgccgcaacgccaaccaccagcgaccaaaatcccagccccagcagcgcactgatgaccatccacgctgccataataaattgtatccacaaccccgagcggaacatatttaacgcgccaatgcggcggacgaagcggctgttaaagatggtcatcacgaacagaaaaacaatgtttagcgcaaagtaataaccaaagttttccggcgcgacgtggttaatttcaatataaacaaacggtccggcgcttaagaatgagaacatcccggcaaagctgaaaccactggcaagcatgtagctcaggacacgtttatggcggaacagcgccgcaaagttaccaatagtggtacgaatgtgaaatggctgacgacgctccggtggtaaggtttctttaatcaggaagaaaatcattgccgaagccagaatcgccgctaatgccaggatccagaagatgtaatgccagctcagccacaccagcacccagccgccaactatcggtgccatcagcggtgcaatggttgtcaccagcatgacaaacgacatcatccgcgagaactcttctttcgggtaaatatcgcgcatcagggcgttaatgaccacgctggccgcagccgcagccagcccgtggaagaaacgcatcacaatcagctgatcgatggtgtttgccaacgcacacgccaccgcggcggcggcaaacaccagcgtaccgccgagcaccaccggcttacgcccgaagctgtctgccatcggcccgtagattaactgccccaacgcaaagcccagaatataagtactgagggtcatctgcgtactgcccgccggtacgccaaactgcgctgaaattaccggtagcgcgggcagatacatatcaatcgacagcggcatcaacatggccagcaggccaaggataaaaacaatagcaaacgacgaatgctgtcgggtggtcacaacgggctcctgaaagtcattgaaaagttagacgacgctggcaatttcttcttcagttaacggacgatattcaccgggggctaaatcagcatccagcgtaataccgccaatacgttcacgatgcagctcaaccacgtggttacccacggcggcgaacatgcgtttcacctgatgataacgcccttcgctgatggtcagacgaacctgcgttggggtaatcacttccagcaccgcaggcttagtgagatctttttcgttatgcagctgcacgcctttagcaaattgctctgccgtatcgtcagctacaggtgattccagtgtcaccagataggtcttctcgcaatgatggcgcggagaagtaatgcggtgcgaccactgaccatcatcagtcatcagcaccagaccggtggtatcaatatccaaccgccccgccgcatgcagtttccacgctaccggttcatcaagaaaatagagcaccgttgggtgatcagggtcgtccgtggagcaaacatagccctgaggcttattgagcatgaagtaacgtggaccgtgttgctgcgccagcgggttgccatcgtaagcgacatcatgttcaggaagcagtttgaacgctgcattacggacgatttcgccatcgacggtgacacgattgccgcggatttcacgcccggcaatagcacggctaacgccgagttgctgtgcgataaatttatcaagtcgcatgtgtgtgattttgcctgtaaaaacggaggtcgggcattgacccgaaaatctgaactgttgtctgcccagtatagcggtctaataacatccctcaagggaaaaagatccatggcatactattagcagaataatctacctacgcgagaccatgatttttacacttcgcccatatcagcaagaagccgtggatgccacgctcaaccattttcgtcgtcataaaacccctgccgttatcgtgctgcccaccggcgcaggtaaaagcctggtgatagcggaactggcacggctggctcgtggtcgcgtgctggtgctggcacacgttaaagaactggtggcgcaaaaccatgcaaagtatcaggcgctggggctggaagccgatatttttgccgccgggctaaagcgcaaagagagccacggtaaagtggtatttggcagcgtgcagtctgtcgcccgtaatcttgatgcctttcagggtgaattttcgctgttgattgtcgatgaatgtcaccgtattggtgacgatgaagagagccagtatcagcaaatcctcactcacctgacaaaagtgaatccccacttacgcctgctggggctgactgccacgccttttcgattgggcaaaggctggatctaccagtttcattatcacggcatggtacgcggcgatgagaaagcccttttccgtgactgcatttatgagctgccgctgcgttatatgattaaacacggctatctgacgccgccagaacgactggatatgccagtagtgcaatacgatttcagccgcttgcaggcacagagtaacgggctgttcagcgaagccgatctcaaccgtgagctgaaaaaacaacaacgtattaccccgcacatcatcagccagattatggagtttgctgcaacgcgcaaaggggtgatgatttttgccgcgacggttgaacacgcaaaagagattgtgggattactgcctgccgaagatgcagcactgattactggcgacacccccggcgctgagcgcgatgtgttaattgaaaattttaaagcccagcgttttcgctatctggtcaacgtcgcggtactgaccaccggatttgacgccccgcacgtcgatcttatcgccattctgcgccctaccgaatcagtgagtctttaccaacaaattgtcgggcgcggtctgcgtctcgctccgggcaagactgattgcttaattcttgattatgcgggtaatcctcacgatctctacgcgccggaagttggtacaccaaaaggcaaaagtgacaacgttccggtacaggttttctgccctgcctgcggttttgccaacaccttttgggggaaaacgaccgccgacgggacattgattgaacactttggtcgtcgctgtcagggatggtttgaagatgacgacggtcatcgcgaacaatgtgacttccgtttccgttttaaaaattgcccgcaatgtaacgcggaaaacgatattgccgcccgccgctgccgcgaatgtgacaccgtactggttgatccggacgatatgttaaaagcggcgctacgactgaaagacgcgctggtattacgctgtagcggcatgtctttgcaacatgggcacgacgagaaaggcgaatggttgaaaatcacctattacgatgaagacggcgcggatgtgagtgagcgtttccgtctgcaaacacctgcccagcgtaccgccttcgagcagctttttatccgcccgcatacgcgcacaccgggcatcccgctgcgctggatcaccgccgccgatatcctcgcccagcaagccttattgcgacacccggattttgtcgtcgcccgcatgaaaggccagtactggcaggtgcgtgaaaaagtgttcgattacgaaggtcgttttcgtctggcgcacgaattacgcggttaatggtagttttgattgatgtataaggcgattgagtatagaatctcgcccgcttttgcatacgcaaagcagatcacttacctgttgctgggtcgcctgtagcaggattaatttaagagagaaagaaatgtttactatcaacgcagaagtacgtaaagagcagggtaagggtgcgagccgccgcctgcgtgccgctaacaagttcccggcaatcatctacggtggcaaagaagcgccgctggctatcgagctggatcacgacaaagtcatgaacatgcaagctaaagctgaattctacagcgaagttctgaccatcgttgttgacggtaaagaaatcaaagttaaagctcaggacgtacagcgtcacccgtacaaaccgaagctgcagcacatcgacttcgttcgcgcttaattgctgaataagttgtaaaaaaccccgctccggcggggttttttgtatctgcagattatgcctgattacggtattgctattttttgcaggccagataaggcgttcacgccgcatctggcattcagaacacaaaaccgattaattgccgccagacgtccggcgctgcaattggtcgcgcaaattcggcggcgtgcctttaatggtcaaggtatcggttgctggatcccagaagatgcgttcacctaacagcatcgcatcaaagttaatagtcaagccaccgccgctaccggcaaacttcgtcaactgacgcagtgtgctacggtctgccgggaagctctcttccagttcgtagcctttttcagccgcaaactccgtgaagctcacttcgcttacgcctgccagctctttcgacagcgatttcagttcgatctcttcgcctgcctgcagctgctcattacagtagctataaacctgctggcgcacgttctgtcgctctgctttatccagttgtgcttcggcagtgaaatcatcaaccgcttgcaacagcccacggttttgcgctttcgcgtttaacccttcgctggccccgaggaaatccataaagaaatccgccactttgcgccctactcgccctttcaggaaagtgagatagcgggtggactctggattggtttcccattcggttaaatcgatacgcgcaacaatatccgcatgattgatatcaagataatgggttgggttgatgtcgagattttcgttaacgcgcatactgctcaggttgctcagaactgccaccagcaaatactccaccgccagatagcgatagtggcaaaacagcacgaatccaccgtcagcaaaaggatatttcgctaattcgtcacgcaggcggccggttgccgcgcggctaaatgccaggaagtcctcttcgccctgacgctgtaagcgcagcgtctgcgccagttcactctcttcgctaaacaagccgtaagctttatttttggcgctatagacccgatgcagttctgccaccatctcaacgacggtttctgtcggttccagcaatgaatcgcgcaacaccagctcaaggttctgctcatcacgcttgataagctggtgcagagcaatctggttgatatccagactcatgataaactctcctttaagaccgggcggtattcaaccaccgccggttaagcgacgcaataaaagatggcggtcattttacagaaggcagcgtaacgagaatgatttaacgcataaaaaagcagaaaaaaaaccgttgctacggtaatatgttgccctttcatcaactaactgatttcgatttatgccacaaatttcccgctacagtgatgaacaggttgaacaattgctcgcagagctgctcaacgtactggaaaaacataaggctccgaccgacctttccctgatggtgttaggcaacatggtcactaaccttatcaacaccagcattgccccggcccaacgccaggcaattgccaactcttttgcccgcgccttacagtcctctatcaacgaagacaaagcgcactaagggaaacagataacaggttatggtaactcatcgtcagcgctaccgtgaaaaagtctcccagatggtcagttgggggcactggtttgcactgttcaatattctgctttcgctcgtcattggcagccgttacctgtttatcgccgactggccgacaacgcttgctggtcgcatttattcctacgtaagcattatcggccatttcagcttcctggtgttcgccacctacttgctgatcctcttcccgctgacctttatcgtcggctcccagaggctgatgaggtttttgtccgtcattctggcaacggcgggaatgacgctattactgatcgatagcgaagtctttactcgtttccatctccatcttaatcccatcgtctggcaactggttatcaacccagacgaaaatgagatggcgcgcgactggcagctgatgttcatcagcgtgccggttattttattgcttgaactggtgtttgcgacgtggagctggcaaaagctgcgcagcctgacgcgtcgtcgacgcttcgcgcgcccgctggccgcattcttatttatcgcctttatcgcctcgcatgtggtgtatatctgggccgatgccaacttctatcgcccgatcaccatgcagcgcgctaacctgccgctttcgtacccgatgacggcgcgacgttttcttgagaagcatggtctgcttgatgcgcaggagtatcaacgccgtcttattgagcaaggtaatccagacgccgtttccgttcagtatccgttaagcgaactgcgctatcgcgatatgggcaccgggcagaatgtgctgttgattactgtcgatggcctgaactactcacgcttcgagaagcagatgcctgcgctggcaggttttgctgagcaaaatatttcgttcacgcgccatatgagctccggcaacactacagacaacggcatctttggcctgttctatggcatctcgccgagctatatggacggcattctgtcgacccgtacgcctgcggcattaattactgcgcttaatcagcaaggctatcagctggggttattctcatcagatggctttaccagcccgctgtatcgccaggcattgttgtcagatttctcgatgccgagcgtacgcacccaatccgacgagcagaccgccacgcagtggatcaactggctgggacgctacgcacaagaagataaccgctggttctcgtgggtttctttcaatggtactaacattgacgacagcaatcagcaggcatttgcacggaaatatagccgggcggcaggcaatgtcgatgaccagatcaaccgcgtgctcaatgcactgcgtgattctggcaaactggacaatacggtggtgattatcactgccggtcggggtattccactgagcgaagaggaagaaacctttgactggtcccacggtcatctgcaggtgccattagtgattcactggccaggcacgccggcgcagcgtattaatgctctgactgatcataccgatctgatgacgacgctgatgcaacgcctgctacatgtcagcacacctgccagcgaatattcgcaaggtcaggatttgttcaaccctcaacgccgtcattactgggttaccgcagcggataacgatacgctggcaattaccaccccgaaaaagacgctggtactgaacaataacggtaaataccgcacttacaacttacgtggtgaaagagtgaaagatgaaaaaccacagttaagtttgttattgcaagtgctgacagacgagaagcgttttatcgctaactgattaattataaatcagttagcgaaatatcttacttgcaatcggtgtggaaaacggtagtattagcagccacgagtcggcacgtagcgcagcctggtagcgcaccgtcatggggtgtcgggggtcggaggttcaaatcctctcgtgccgaccaaaaatcccaagaaaaaaccaacccttacggttggtttttttatatctgcaattaattcgataaacagaccgtgacacatcacagcctgtttattttctgttatcagaacgtccagaccacacccgcctgagtattccacggcgattctacccctgcgccattgccatagctgactgacaaatgaccgcttaacgtcggggtaaacgatgaccttataccagcctgataaacgccactggttccagccacatcattattaaatttgccatcgtcattaactttcacctggttagaatcggcgtattcctgacgcacggccgctttcagccagggttccagcgtcgtaccgttttgcaggtccatgtgatagcttaccgccgttcccgcttcagcgcgtaatatccgggtatttcccacatccgcgcgcatgccgtttgataacgtgtagtcctgaccatctgtggtaaagccggtaaaggccagatagggtctaacactccacaatccgtcaacccaacggaacccgctctcaacatgagcacccgcgccgttactattgtaatcgccaaacgctgttgccccattactcatcttgccatggatggtgttggcaaaacggtcaactttcaccaccccatcaacataggcaccgttctgatgctcccaaccggcataagcccccagggtatagctatcgatattacctttgccgccgcgatcaaaaccaatatcagaatgagagtaaccaaagatcaagccgcgaattgtactgctttcttcacgggagaaacggctatcgataccgagcgtcaggcccgtcaatgtttgctcaaaaccagctcccgcatcagtggtcacgttgttgcgggtgttaattgccgaactccacatcgccgtatcgtaactaacgccttttacgctaccaagacgctcacgcacggtgtccagttctgcatcaaataccagcggttgtgcggccgccatattcagcacatcagtggttgaaggggtaatttgcgcgcgattctctgccagactccagctatggttgccattatccagcaaggtatattcatacgtaccgatatcaacaacgcctccggcattgcccaacgtaaatgcagcatcaccgccgcccgttgttaccagtgtaaggctatctcctgctgccgggctggcaccggtgtccgtcacgaatattttgaaatcacctgttgcctgaccggtgacgttgagctgatcgctctgatgattagccatatcggtacgcatataaaaattgccgtttcccgacagggtattggtggtcaacgtaatgaaattttccgcacttgccgtcactgatgaacgagtcactggctcatccatcataatcacatttgcgtcagacatcgcaaggttggctaagttgaggagggtgttttggttcgtcgtagtgatatcggcaatgatggtccatacgctattttcgagcgaaacgtccgctttgctggtatccacggcaccatgcgttctaaaagaagcgccctcagaaaccactaccttacccaccaacattgcgggtgcataatttatttgcggcttcatgacctcaagaatgccatcattccctctgactgaaacgttaaccattgtgccagcccagacgttagcgcggccattgttgataaccatattttcagagatggcttttgaggaatacgtgatacttccattctgatatgatcgaccgagatcatataccgcatttgcctgcactttcgtaccagtatcctttcccagcgattgcatagtggcatgcttatcaaggatagtatcaatggcctgcgtgtcctccataacaatgagcccggaaccatcatccagttcataattttttgacacaccatcttttatactaaattggcctttactgtttggaccactcacttccagcgcattcgttgagacaattaattttccgcctgcttttttatcaacgccagttacagtcccgccatccataacctccagtaagccgccactatctacagtggtattataagcgaagtcattttcttcaactcgcaaacttccgccgttttccaacaacatattattagcaataccattcttgatatcgaactgaccgagacggtttgttccgaatacctccatggcccgcgtggttgttttaatagcaccgcctgctttctgatctaccgcaaatgcaaatcccccctctttaacctccagtagtcctcccttttcgatagcgacaaagacggcccccccatctttttcaacgattaagcgcccgcctttaatcgtggtatcattcgctgcgccataaacctgtagcacaccattattgagcgtagtctggtttgccgcgccacccatttgaacaatttgataaccgtcatttaatactgagtattctgcggcgccattcatttcaatgtactgataccctccgttaatttcagtattattacttacaccaaattcttttatatgctgttctccgccaggattgattttcgtattattggcggtcccataaaccagctggatatctttttccaggacaacaccatcaactgtctcaccatactcaacagttgatgccaatgctatgggtgaatataaggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccataacgctgtagccaccagaacagatattgcggaacgacaaagagaaacagaaccagattgatgcattgagctttcatcctatgaaattaattgctgttaaaagcattgggtacagaaaatacccatagctccatacccggagtcagtttttaaaaactgtttaaagaaatgcacaagtattgtgattgattttttagttgtttttcttgatgagaagctgatgcaaaattccgtctttataatgaaaatgatgccaaagcgaacgacaaggttgtagttttcactacatgtccatacataaaatggggtaacattcacgcgcctggtagcgttaccaacgctacgctcaaacataatgattctaataaaacctcaggagactactatgcctgaagcaacaccttttcaggtgatgattgtggatgatcatccacttatgcgacgcggtgttcgtcagttactggagcttgatcctggctctgaagtggtcgccgaagcgggcgacggcgcgagcgctatcgatctggcgaatagactggatatcgacgtgatcttgctggatctcaatatgaaaggtatgagtggcctggatactctcaatgccttgcgcagggatggcgttaccgcgcaaattattatcctgaccgtatccgatgcctccagcgatgtctttgcgctgatagacgcaggcgcagacggttatctgttgaaagacagcgacccggaagtattgctggaagcgattcgtgccggagcgaaaggcagcaaagtctttagcgaacgcgtcaatcagtacttacgtgaacgtgaaatgtttggcgcggaagaagatcccttcagcgtgctgacggagcgcgagctggatgttctgcacgagctggcacaggggctgtcaaataaacagattgcctcggtgttgaatatttccgagcagacagtaaaagtacatattcgcaatctgctgcgtaaactcaatgtccgctcacgcgtggcggccaccattctgttcctgcaacaacgcggggcacaataaaaatagcccgatggatttatcatcgggctgagatttatgacaaacgcaaaactgcctgatgcgctacgcttatcaggcctacgtggatcgatcaatttattgaatttacacaattttgtaggccggataaggcgttcacgccgcatccggcataaactaagcgcactttgtcaacagtctagcccgatggcatcaccatcgggcctctttttatttactctcctgcggcgacaaatgttgcatcgcctgcgcgatactacgttcaatcaccgcacggcgagtatcgttggcaggtaagagtttcaacatcatctcccacgcggcaacggcttcgccaaatcgctgctgctcaaaggcattaaacgcatacatgcttagcacacggatattgctatggtccgttctcaccagctgacgtagcagttcaccgccgaggcggttgtcgttgggatcagatgaacgagtcaacgcttcagcgtatcccagtgcagcatcactgtttttcggatcgaggcgatacgcagtggcgtatgcatcggtggcgatactggcgttacccagcgccatgccaacgcggcccaacataatccagccttctatatctcccggatttttttgcagttgagtacgcatccccagcgcaagacgcgacatctcttcttcgttgagcggatcggctttcggatccagcgccctgtccagcaacgccggagcctgtgccgtggcctgctgccagattttcacctgctgataattgccagtctggtagtagctgacgccagccacaattaacgccaccacaatacccggcagataaacaacatatccggcacgcttaccttccggcacgctttgttcaggaaacgcttccggcaccacgcgtacccgacgccgcgagcgggcgtatatgacccaaccgccaatgccaatagccactactggcagcacccacagcagcacggtcagcggcgttaacggcggatcgtaagtgacgaagttgccgtaacgcgccaccatataatcgacaatctcttttttacttttaccttcctgcatcagttcatacactttctgacgcaggtcggtggcaatcatcgagttggaatcggcaatgctgttgttctggcatttcgggcagcgcagttcttcagtgagctgacggaactgttgttcctgtgcttcatctttaaactgcaacacatcgatggtcgccagcgctgagccggagatcatcagcatcagcacgcccaataaaaacctcattgtgcggcctccttactgtatttctcccacagcggcttgatctcttcttcccagacgcgaggattcagatcgcccgcatggcgatagcgaatgatgccgttgccgtcaataagaaacgtttctggcgcgccatagacaccgagatccagccctaacatgccatcgccatcaaacaggcttagcgcgtaaggattgcccagctctttcagccagctgattgccttctggcgatcgtctttatagttcatgccgaccacgcggatgccctgcgcagaaagctgattcagatattgatgttccgcacggcaggtcggacaccaggtcgcccagacgttaagcagtactggtttgccctgagtcagcacatccgcctgataaaactgccccggattgtccagtgattcgagacgaaacttcggcacaggcttgccaatgagcgccgattccagattggtcggatcatccccttcggcattacgcgccagctgccacagcagcgccgcggcaatcgccaggaagataatcaacggaattaacaatactttgcgcttcatacggcctccggcgcagttttttgcggactcacgcgcttacgatagcgaggatcaaacagacacagcagtccgcccaacgccatcatcagcccgcccgcccaaatccagcgaacaaatggtttgtagtaaagacgcacggcccacgcgccgttttccagctcttcaccgagggccgcgtacaggtcacgcgtgatgccgccgtcaattgccgcttcggtcatcatcgacccggcagtgttgtaataacgtttttccgcatacagcaccgtttccggcttgccatcgcgcgttacgccgatagtcgccacaccgccacgccagttcgggccagtcacctctttgacatcacggaaggtgaagcgatattcatgaatatcgacgctatcgccggacttcatgcgcacatcacgctcaacgctatagttctggctaaaggcaatgccaacaattgtcactgccagcccaaggtgagccgccaccatcccccaataactgaaggtggttttcgtgccgcgtgaaatacgtagcgcagcttccgcaattgccagcaccgcaatccagcaggccattgccaggccgagcaccgtcatcgccacaactttgctttcgaacagccacggcaacagcagcgacagcaccagcgtagagatgaaggcgataatcaataaattgcggatcttacgcgggcgatcccgcccccagcgcaccagaggaccgacaccaagcagtagcgcaaacggcaccatcagccaggtaaacatggtgttgaagaacggttcgccaatcgaaatactgcccagtcccagttgcttatgcaccaacggcagcagcgtccccagcaacaccaccagcatcgcagcgaccagcaaaacattgttcgctaacagcaaagattcccgcgaccacagcgcattgtttacgcgtgagcgaactttgtgtccacgcgcggcaaacagcagcagcgaaccgccaatcaccagcaccataaaggcgaggataaacataccgcgcgccggatcagacgcaaacgcgtgtaccgataccagcacgccggaacgcacgaggaaagtccccaacagacacaacgagaaggcactgattgccagcagtaatgtccacgctttgaagctggcgcgttgttcagtgaccgccagtgagtgcatcagcgcagtccccaccagccacggcataaacgaggcgttttctaccggatcccagaaccaccagccaccccagccgagttcgtaataggcccatgcggaaccgagcacgatgccgagcgtcaggaagatccacgctgccagcgtccacggacgagtaaaacgcgcataagtgctgtccagacgcccgctcagcaaagaagcaatggcaaaagcaaacgccaccgagaaacccacgtaccccatataaagcagaggcggatggaagatcagccccggatcctgcaatagcgggttaagatcgcgaccttcaatcgggaagttcggcaacgtgcgagagaacgggttagaggtaaagagaatgaacagcaaaaagccgacactgaccatccccattatcgccagtacacgggccacaatatccagcggaatacgctgactaaaaatcgccaccgcaaaggtccagccgctcatcagcagcacccacagcagtagcgagccttcatgcgcgccccaggtagccgccacgcgataccacaccggaagctgggtattggagttgctggcaacataggtgacggtgaagtcgttgaccacgaaagcattgaccagcaccagaaatgcgccagccacagacataaacagcagccaggcaaacaagcgggaagacgccatcatgcgcgcatctccgcgcgccacgccccatagcggatacacggacagcagcagcgcaattcccagcgccaggcacagcagtccgttaccaatttctggcatcatgatgctgggtccttataaacactcgccgggcgacggtggttagcttccatcgctttctcaacttctggcggcgtatagttttcatcgtgtttcgccagcacttctttcgcgaggatatgattgcctttttccagttcgccctgcaccacaacgccctgcccttcacggaacagatccggcaaaatgccttcgtaagagacatccactgagccttcagcatcgtaaatggtgaaggtcactttcagcgaattgggatcgcgctgcacactacccggcatcaccatcccgccaacgcgcagacgctgaccgacttccggcatttgctgagtttcacgcttgccgtagagaatttcccccggcgtataaaagagatcgatattcgagcgcagcgcatatagcaccagaccgatagtcagcgccagccctgccaacacggcacaggcaatccacaagcggtttttacggcgaatattcatgcagcctcctgctgttgcgcagcacgtaaacgcgcctcacgcgcccgctgttgcgccacgccacgcagaattgcgcgatgttgcatcaccgagtgcacgaccaaaaccaccagcggaataacggtcatcaccaccgccagccagacaaaaaaggcgtaaccgcccattgcgaaaaattcattccaggaagcaaatgcaggggtcatttacggcctcttttcagtatcagttcactcacccacggacggcgtttttccatcagcaaaatcaaattacgcatccgcatcagcgtcagcgtggcagacaggagcaggaagccaaaaatcgaccagcgcagcggcgaacgcatcgccggatcgatactttgctgcatccgcgttgatccctgatgcagggtgttccaccactccacggagtaatgaataatcggcagattcaccacgccaatcagcaccaggatacctgccgcacggcccgccagacggcggtcgtcgaaggcgtgccacagggcaatcacacccacatacaaaaacagcagcaccagttcagaagtcagacgtgcatcccatacccaccaggtgccccacatcggttttccccatgcagagccggtaaccagggcaataaaggtaaacacggcaccaatgggggccatcgccgccaccgccaggttggccattttcatctgccagacaaggccaataaacgctgccactgccattgatgcataaatgcccatcgaccagatcgccgcaggcacatgcaggtagataatgcggtagctatttccctgctgataatcagccggagcaaagccgaatccccagatccagccgacggtaagcacgaccacactggcaattgccagccacggtataaaccagccacagatttgatacagccgtggtgggatcgccagttgatgcagtgttttccacatagtttcgataccagactcgaacaaaaatcagtaatccagcgttattgaatgctgattcgtaacgctgccgccgtcgcaaaaggacttaatgtcgcggtgcctgccagcaacgcgcctaaaattgccagatacccgtcaacgggcaaatgcatagaagccgcgtccatcgcggcggtggcaaagatgagtaatgggatagtcagcggtaacaccagtatgctgagcagcacaccaccgcgcttaagtcccactgtcagcgccacgcccggtgcaccgagaaagccaagcgtaggcgttcccagcagcagcgtcagcgccatcacttgccagccataaacatccattcccagtagcattgctaccagtggcgaaaggatgagtaacggcagaccggttaccatccagtgcgccatcaccttcgccagcacaacggcgggcaagggtaacggcaacaacatcaattgttcaagactgccgtcctgcaaatcgtcacggaacagtcgttccagcgccagcaaggatgaaagcagcgcagcaacccagataatgcccggtgcaatacgcgccagcagttgcggctccggaccgatactgagcggaaaaagggtaattacaatcaggaagaaccacagcgggttggcgatttcggcgctatggcgaaacgctacacgcagctcaagacggaaaatgcgccagaacatcatgcggccctcgtttgcgtcagtgaaatgcggcgaattttactttcagcaacgttgagcggctggtgggtagtcagaatcacaatccccccctgctccgtatgctgcgccatacgctgggtcagacgatcgacaccgttaacgtcaatcgcggtaaaaggctcgtcgaggatccataacgtggcacgggtcagccacagacgcgctaaagcgacgcggcgttgttgcccggccgagagctgatttacaggaatatcttcgaatccggcaagcccggcctgcgccagggcttccagacattgtgcggtatcgccatcgcgatgataaaagtgcagattttctaacgccgtcagccgggttttgatccccggctgatggcctatccataacaggttttgatggtagctgtcgcgtacctgatgcaagggctgcccttgccagagaacctcgcctgcgtcagggcgagacaaccccgtcagcaaacggagaagcgttgtcttccccgcgccgttgctaccggtgatttgtacccactctcctgcgttcagcgtaaatgacaagccactaaataaggttcgttcatcccgctcacaaagtaactctctggcttcaagcatacccacgcaataaccctgttaaaaacctggctcgacttcacgcatatcgggcagcttgtgcgctatccctttatggcaatcaatacaggtttgcccatctttcaccgcctggtcatgcatcttcgcggcaaccgatttctgggcggttgtatccatatactcgaagttgtgacagttacggcactcctgcgagttattgtccttcatgcgccgccactcattctgtgccatcgtcagacgatgagcttcaaatttctgcggcgtgtcaataacgccaaaaattttaccatacagctctttacttgctttgagcttgcgtatcatcttcggcacaaactcgtgcggaacgtgacaatccggacaggtcgcacggacgccgctacggttgttgtagtgcacggaatccatgtattcctgatacaccgtgttgcgcatttcgtggcagctaatgcagaactcttcggtattggctttttccatcccggtgttaaagccaccccagaagacgatgccgccaacaaaaccgatcaacagcagcgtccccagcgccagacggctgggggtacgccaccatttccacaggcgcttaatcagaccaggcttacggtcagaatttcccataataacctcttatttcccgtaaccttttgatggggtaaaggtattccccacgattggcgcggtatcggcctgcggtacgtgacattgcagacagaaataacgacgcggagccacttccgcgcccactttgccgtcgctgtccataaagtgagtaggactgatacgcggcgcgccagtggtgcgatagctttcgacaccgtggcactgcaagcagcgattggtattggtcgttacctgataaccttcaacgctatgcgggatcattggcggctgattcacatagttcagcggcatccgatcctgctcttttggcatccgaatggccccttcctgtgtcccggatacttccggcgactggctaaaatcgacgccattagccgcccaaaccgcgccgcttaccaccagggccagcatcgccgtccattgacacagcgctttcttcaggtcatggcttttcatgatttcgctcccgaactccatcgtgtagttattgtaaatacatcctcagaacagacatccacgcagcgaccgcacgtcatgcaatcgcggctggtgacctgcaccgggctttgttcatccagcaccggggcacgtagcacatgcggttccgggcaaacatgaaaacaatccatacagcggttacatttctgccgatcggtggccgcaacggtaatcacacctttgctacccagcacgccatacagcgcgccaaccggacaaatgtgcccgcaccagccgtgttcaacgaccagtagatcaaataaaaacagcgcgagaataagcagcgcgccgctgccgaagcccattaccaggctacgccccatcagagaaacggggttgatccattcccaaatgagcgtgccagttaaggctgatcccaccagaatgaccaccaacagcacgtagcgaatgtggcgagggatcgtcgcagactgattgaggtcaaagcgcctgcgtaaccagttcgctaagtcggtaatcgggttcagcgggcagacccagctgcaaaataatcgctttcccgccagggcgtagagcacggtgataatcaccgcaccggtcaacgccaccgtggcaggcagatgaccactggcaagactttgcagcgtcatcagcggatcggtcagcggaacggtgtcgaataacaggctactgctgtagttgccgtgcaagatccacacaccaaaccatggaccgctcaaaaacatccccagcacgaagaactgacaaaggcgacgtaacaccagccaacggtgactgcgccaccagccttttttctccagcgcctcgcgcccggcgtcacgtttacgatttgccattgttcccctccagccagccgaagcggtaatggtgacctaactcccctttcgccagtgacagcggtaacaccttgattgccggttgttccagcacgcatactttttcgcacttaccgcaaccggtacaggcgtcgctgtgaaccgtcggcagaaagcgggcgtgcttaccggtacgcgtgttgcgctccagctccagggtgatggcctcatcaattttcgggcattcgcgataacaaacatcgcagcgcagcccctgaaagttgagacagttttcctggtccaccagtaccgccagccccatccgcgcgtcgtcgatcgattcaatctcacgatccagcgcaccgcttgggcacactttggcgcacggaatgtcctcacacatttcgcaaggaatatcccgtgcgacaaaatatggcgtgcccgccgacagaccagaggccagcgtcgccagttttaaggtgtcgtaagggcaagcctgaacacactgaccgcaacgcacacaggcactggcaaaggcgttctcgtttatggctccgggcgggcgcaaccgcacgccagatgcgcgtgcggtttgctgttgtaaccccagcgccacacccacggcagccagcccgcctgctgtgcgaacgacatcgcgcagaaagcggcggcgaccattttgaggtttcgctgaccgggacataatggcttacaccttctccagtttgaccgcgcacttcttgaagtccgtctctttcgagagcggatcggtcgcatccagcgtcagtttgttaaccaactgtgcggcgtcgaagaacggcatgtacaccaggccctgtggcggacggttacgaccgcgcgtttcaacaatcgagatcacttcgccacggcgagaaaccactttcactttgtcgccacggcgcagatcgcgcgctttcgcatccagcgggtgaataaacaggaccgcttccgggaaggcgcggtgcagttctggtacacggcgagtcatactgccggtgtgccagtgctccagaacgcgtccggtagagagccacaggtcgtactcttcatccggtgcttccgccgccggttcgaatggcagtgcgaagatcaccgctttgccatccggtttaccgtagaacttatagccttcgcccgctttcacgtacgggtcgttaccttcgctgtaacgccactgcgtttctttaccgttcaccaccggccagcgcagaccgcgcgctttgtggtagtcatcgaacggtgccagatcgtgaccgtgaccgcgaccaaaccatgcgtactcttcgaacagccctttttgcagatagaagcccagctcgcgggattcatcgttcagctgatcttccgccagttcggataccgggaatttgctcacttccggtgtggcatacagcacttcgtacagcgttttgccacgcagttccggtttcttcgccagcagatcttccggccatacttcttcagttttgaagcggcgggagaactggactaactgccagagatccgatttcgcttcgcccggtgcctgtacctgttgacgccagaactgagtacggcgttcggcgttaccgtaagcgccctctttctctacccacattgcggtcggcaggatcaagtcggcggccagcgcactgactgtcggatacggatcggagacgatgatgaagttgcgcggatcgcgccagcccggcatacgctcttcattgatgttcggcccggcctgcatgttgttggtacacatggtccagtaaacattcagtttgccgtctttcagcgcacggtcttgtgccaccgcgtgcagaccgattttcgccggaatggtgccgctcgggatattccacttcttctcgcagatatcacggtgtttctcgttggtcaccaccatgtccgcaggcagacggtgagcaaaggtgcccacttcacgcgcagtaccacacgcagaaggttgcccggtcagggagaacggaccgcaacccggctgggaaattttgccggtcagcaggtgcaggttgtagaccaggttgttagcccacacgccacgagtatgctggttgaagcccatcgtccagtaggagatgactttcttgttcggatcggcatacagctgcgccagttgttctaactggtctttcggcacgccggtcatttcggcagttttttccagcgtatactcggcaacgaaggctttgtaatcttcaaagctcatcggttcggaggcgtcagaacccggattcttcgctgctttttccagcggatgggtcggacgtaaaccgtagccgatgtccgtcgcccctttgcgcaggttaacgtgcttgctgaagaagtcctgatttatcgcattgttttgaatgatatagttggcgatgtagttcaggatcaccaggtcagattgcggcgtaaagatgatgccgttatccgccagctcgaagctacgatgctggtaggtagaaagcaccgccacggtgacgttctggttagagagacgacggttagtgatgcgcgaccagaggatcgggtgcatttccgccatgtttgcgccccacagcacaaacgcgtcagcctgctcgatgtcgtcatagcagcccatcggctcatccataccaaaggtacgcataaagccaactactgccgacgccatacagtgacgcgcgttcgggtcgatgttgttcgaacggaagcccgctttaaacagcttggacgcggcataaccttcccagatagtccactgaccagaaccgaacataccgatcgattccggccctttttctttcagggcggttttgaatttctcttccatcacatcgaaggcctgatcccaggtgattggggtaaattcgccttctttgtcatatttaccgtttttcatacgcagcagcggctgcgtcaaacggtctttaccgtacatgattttgggcaggaaatagcccttaatgcagttcaggccacggttaaccggtgcgtccgggtcgccctgacaggccaccacacgtccctgctgcgttccgaccagaacgccgcaaccagtaccgcagaaacggcacggcgctttatcccatttgatggcttcctgctgaccaacaacggcgcgggcaacgcccggcacgctgagaccggcagccgccgcagcggccgcaacggcgttagctttcataaagctacgacgactgagtttcatggtgtttcctcaccttgctcttcctgctggtgataaaccagcgacaccgccagcacgccctctacgttgcgtactgactcaatggtttggatcagcgtttcgctgtcttctgcttccaccaccacaatcaactgaccgctcggcgcgtcgctgacagcaacttcacagccgggaaaggcgttcagttgggtgctgatgtctgaaattcgttcgcttttggcctgcacgaccaggctgcaaacttgccagttagtgtgcatggagatactccgcagttatggctgataccggacagctggctgcacatgctccacatccgttgcaaagttggctattaagttgcggctggtagatcccggagagcgtcgggcgaaagataattgccattggctcacagctatcctgacagcggcggcattcaactgactgatacgccaggcacgcgtccccgatggtgaactgcaaatcccaggccctggtgtggcgcggagaaaatagcgattcggggcaagcctgcgcgcaggcgtaacagaagctgcactcgttatttttgaaattaacgctcggatagccgcccgcgccgcgttgcagaatgttgttttcacaagcattaatacaggcgtcgcagcgggtgcaatgggtcagaaaatgagattcatcaccggaccagggcggacggataccgttactggctttgcgccagcgaccagtgagtatgccccgacgggatgcatcaatcttcacattgaccttccatcattaacgcgctctgaaaattgagagcgaccaaataaaccgcataattaataagccatttttatagccgctaagatattaaaggatgtgtcaaagatgcataccccgatcggggtaaaacctgtagcaggatcaaaagagtggcgggaagcgtggcaaaaacgggcttttgctcacatttcaaatggttataaatatatttatatagcgattgattcaccagagatatttctgctggtttgctctctcattagaatttaacactaaaagagcaggtaaaattgtctgaatgttctttaagttattcataaagcaaattaataaatctgatgaatatgttaaccttcagcgacatcatcggtgaaaacctataaatgaagaaggaaagcaaaaaaatgaagaccattctacctgcagtattgtttgccgctttcgctaccacttccgcctgggcggcagaaagcgtccagccactggaaaaaatcgcgccttatccacaagctgaaaaagggatgaagcgtcaggtgattcagttaaccccgcaagaagatgaatctaccctgaaagtagaactgttaatcggtcagacgctggaagtcgattgcaatttgcatcgtctcggcgggaagctggaaaacaaaacgctggaaggctggggctatgattattatgtctttgataaagtcagttccccggtttcaacgatgatggcctgcccggatggcaagaaagagaagaaatttgtcaccgcgtatctgggcgatgctggaatgctgcgttacaacagcaagctgccgatcgtggtgtatacgccagacaatgtagatgtgaagtaccgcgtctggaaggcggaagagaaaattgacaacgcggtagttcgctaaactgccgtgaagtgcggcaccccgtaggtcagacaaggcggtcacgccgcatccgacatccaacgcccgagccggttgcctgatgcgacgctggcgcgtcttatcaggcctacaccgctgtgaagtgcggcaccccgtaggtcagacaaggcggtcacgccgcatccgacatccaacgcccgagccggttgcctgatgcgacgctggcgcgtcttatcaggcctacaccgctgtgaagtgctccaccccgtaggtcggataaggcggttacgccgcatccgacatctaacgcccaagccggttgcctgatgcgacgctggcgcgtcttatcaggcctacaccgctgtgaagtgctccaccccgtaggttggataaggcggttacgccgcatccgacatccaacgtccgagccggttgcctgatgcgacgctggcgcgtcttatcaggcctacaccgctgtgaagtgctccaccccgtaggtcggataaggcggttacgccgcatccgacatctaacgcccaagccggttgcctgatgcgacgctggcgcgtcttatcaggcctacaccgctgtgaagtgctccaccccgtaggttggataaggcggttacgccgcatccaacatctaacgcccgagccggttgcctgatgcgacgctggcgcgtcttatcagcatacgccacatccggcataccatgccggatgtggcgtatcattacaacgcaatatccgccacttctttttgaacgggttgcggtttcaactgcggtttcggcgtactatctgctgcctgcggcttgtcgtagttcaaccccagcacttcgctggtgtactgcaactcgcgttctgttgccgctacatcaccgttcagcttgcgtccataagacggaacgatcgctttcaacgtagcctgccattgcgggctggaaacacgatcgccaaatactttttccagcagattcaacataatcggcgcggcggttgacgcccctggcgatgcccccaggagcgcggcaatggttccttgctggtcactgacgacttcagtacccagacgcagtacgccacctttctcggcatcacgcttgataatctgcacgcgctgccccgcttgccacaaacgccagtcctcttttttcgcctgcggatagtactctttcaacgcttcaaaacgatcctcttcactcaacatcacctgactcaccagatatttcaccagatcgaaattatccagcccgacgtgcatcatcggcatcacgttagaggtggtggtggaactcattagatcccacaatgaaccgtttttgaggaatttggttgagaaggtggcaaatggcccaaacagcactacgcgtttaccgtccagaacgcgggtatcgatatgcggaaccgacatcggtggtgcgccaacggatgctttaccgtaaaccttcgccagatggtgattaaccacgtccgggttttccgaaacaaggaactgtccgcccaccgggaaaccggcgtagtctttcgcttccggaatccccgattcctgtaacagcttcagcgccgcaccgcccgcgccgataaagacaaatttggcacgaatgttctgtgcagtgccatttttcagatcggcaacggtaacggtccaggtgttatcgtcattacgctttagggcgcggacttcgctgctgagttgcagcgagaagttagatttcttctgcaaggaagcaattaactggcgggtgatctcgccgtagttcacatcggtaccaatttccgtacgcgtggctgccactttctgttgcggatcgcgcccttccatcactaacggtgcccactctttgatctgcgcgtgatcttcagagtaacgcataccgcgaaacagcgagctttgttgcaacgcggcgtaacgggcgcgcaggaaattgacgttatcctcgccccagacaaagctcatatgcggaacggtattgataaatgaacgcggagtacgcagcacgccgcgctcaacctggtgcgcccagaactggcgggaaatctgaaatgcttcgttaatggcgactgctttttcaatactgatgctgccatcggcgttttgcggggtgtagttcagttccatcagtgcagaatgcccggttccggcgttattccagccgttcgaactctcctgcgcgacaccctccaggcgctccaccatggtcatcgaccattcaggctccagctcgcgtaaataggtccccaacgtggcgctcataatgccgccgccaatcaacagtacatcagtttcctgctcctcggacgctttcgcttttgccgccatcgaaacggcattaagccccacggccatcgagaagagcatggcagtcacttttttcatcttgttaatgccttacttttagtcgctttattgcaggtgagatttgcgcggcatcaacggtaacacttaagtaacaacatttaaataatgtttataaattatattctaattttagaaacattataatttcgttgattaattatagggttattagaaatgaagggatttttagcatattgacctgacggcagcagtccgccaggtcagcgtcgtaatattatgccgtccgggcaacggcatcacgcgaagcggcatcgcgctcttcgcccgtcagctcgctaagttgcccattgcgcatttccagcaggcggtcggcgtggataaagtaatgatcatcatgactgatagcgaaaatagttttacccatctcctgcatcagcggcagcaacacctgataaaactcacgacggaagtgtggatcctgatccgccgcccattcatccagcaggataatatcgcgttcttctgccagcgccagcaacagcgccacgcgttttttctgcccttttgataacttcaggttaacaatacgcccgttgcttaactcaagcttatgagccattttcagctgcgccagccacttctcaaccagttgcgggttagcgggtttaccctccggccccagcagttgatcaaacagccagacatcggtaaacactgccgaaaacagtttgcgataatcttccggttgttcgccgctgacaggtttgccatccagcaagatttcgccgctttgtggctgatacaagcccgtcaacaacatcgccagcgtcgattttccgctaccgttgccgccaatcagaaacagcagctcgccacgtttgatggtgagattaatcggaccaacggaaaacgcgttatcctgataagcaaacgtcacgttacgcagctccagcgtttgccagttgggaaacgcctgcgggcgcggaaactctgctttgaaaggcgcgagcgcgaatttgttcagcttgttaaacgccacctgcgccgtcagcagcgtcggcaatgcgccaaccgccgaaagcagcggcgtacgcaggaataaaagcgtcaacgaataggtcgcggcaacgttggtatcagcccaaccgaggctgttcgccatccagaacaccaggccgattgcgcccagcatcatgatgtttgaccagttcacggcactaagatggaaggtgtctgcgcgaataatatggtggcgatactcttgcgcatcaggaatgtagaggttgttaaacacatactcggcgcgttcccggttcagagtcagctctttgcgcccttcaagtacagtttgaaaatccgtgtacagcttgtcttcggtttcacgcagggtcgccatatgtttgtacacccgcgccaccagcacaaaaccgccccagatggtgatcgccatccagatagccgttaccagcaacattttgcccgacagcatccacagatacgccgctgaaccgatagtgagaatgatcccctgcaccagttccggcagacgcacaaaagcaatggtgatattgcgcacatcgctggttaaccccgccagcaacgaggcgctaccgagttgttcaatgcgctcgacgtgagtatccagaatccgcttgataaattcactacgcagtcggtaaacgaagtgatgccccaaagtggtgagcgccagttgcgatccgagagtgactgccatcaacagcagcaataatcccagaaactccggcaacaccagcagactggtatccgccgtttcgataaggcgctgattgataaaagcaattaagccaatgcctaatgccgcactggcgaggcttagcgccatcacactgataaatggccagcgatactgccgccagacaagtacaagaagttccatgcagaaaacccggacaatgaattacagcccgcagtttaaacatcttcgcgcgcacagcaataataattcttatttttattcttttttacctgcctgacggaatgtcaggttgtagcggcagtcgatggtgagtggatgaaaccccgctttcaacggttgaataccgtgataaaacagccgcgattcaccgccccataccaccacatcgccatgttccaacaacaaacgtttgagcggatcatttcgtttcaggccgccaaattgaaaaatcgcgggtaagcccagagaaacagaaacaattggcgcgcgcagatccggttcgtctttatcctgatgcagcgacagtttcgcgccaggagcgtagcggttgataagacaagcatctggctggaaatctggatagcccgccgccgtagccgcacgttgacataaattatgaaaactctgtggcatggcgggccacggtttatttgtttgcggatcaatgggcgaatagagataaccttgccgatgggtcgtccagcccagatgcccacagttggtcatcgccaccgacatggtatatcccccgggggtgaccatctggcgaaacggcgactggctggcaacgtcattaatatcgcggatcagttgctccgcagcgttaaaagcaaaacgccgtaaaattaccgcaccagccgccagtggctcttgccacggttcagcatcggcaaacagatccaacattacctctcctcattttcagcttcgcggcgcagcagttgcgctttacgcgacacgccccagcggtaaccggaaagtgtgccatcaccacggaccacccgatgacagggtattatgatagccagcttgttggcggcacaggcgctggcaacggcccgtaccgctttcggtttgccgatggcgttagccagttgctgataactgacggtttcaccgcaaggtatcgtgcgcagtgcctgccagacttgttgctgaaaagcagtgccgcgaatgtccagcggtaacgtcagcggcgtatcgcgttgattgaggctggcgatcacttcacgcacatgttgctgaaacatcagatcggcaggcgcgttgtcggcagcgggaaacatctgctgcaactcgctgattagtgtcgcgtcatcatcgcccagcaatatcgcgcaaatcccccgctcgctttctgccaccaggcaacgacccagctcacaatcagccagcgcgtaacgcaccgccagattttcgccaccgtgacggaattgtttagccgtcatgcccagcgtttcgtcagctttgcgatagtaactgctgctgtcggggaatccggcgttaagaatagacgtcgtcacgctctcccctttcgccagcgattcgcgcaaacggcgagcgcgccaggcctgttgccaggctttaggcgtcattccggtagtcgctttaaacaaccgatgtagatgaaatggactcatcgccacctggtcggctaaggcttccagcgttacaggcgtttcctgttccagcagtcgacacgcgtgggtgattttatccaaccgatgttgctgggcattggctttttctggctgacaacgtttgcaggggcgaaagccagcggcgagtgcctcgctggcatttgcgtagaaggagacgttttcccgcaaagcatgtctggcgcggcaagacggacggcaaaagatgcctgtggtacgcacggcgaaaacgaattcgccgtcggcattcgggtcgcgggctaagacagattgccagcgttgatcgtcagttaagcatgtggcttttttcataatcagctccctggttaaggatagcctttaggctgcccggtcaccatcacgcaaaaaccaacaatcttgcgctttaatttttttcgctgacaaggaagcttttaaactgtggtgacatccaggttttaaagctatcgccttctttggtgatcatataaaccgccagcccttcccggcgaacaacctctttagctttctccggcccgagtaccatcaagccagtatcccaggcatcggcttccagcgccgtcggagcaatcaccgtcacggataccagattgtgttcgatgggacgcccggtttgcggatcgataacatgggaaagacgtttgccgtccagttcgtaatagttacggtagctgccagaggtgctaatcccatgaccgttgatatccaccacagcctgaaccgcgttttctttatcggttggtttttgaatcgctacccgccacggcaggccttcaccgttcataccacggctgttcagcgcgccgcccaccgacaccagatagcgggaaatcccttcctgctccatcaagcgtgccaaatgatcggccgcatagccttcgccgacggtggagagatcgacatataaatccggcaggtctttttgcagatattgctgatgcgactgattgatgaccgtcaggtgctgtaagccggttttggctttcatcgcatcgatctgttcctggctcggaatttgaaccggctgttgttccgggccaaagccccacagattcaccagcggcccgacggttatatccatcgcgccatcggtcttcgcgccaatgcgcagcgaggtggtgacgatatcggccatcgcttcacttaccggccacggcgataaactttgcgagtcgttaaagcgcatcagcgcggaatcttttttataggtcgaaagcagctgatcgtcggcgtccagttgggtctgaatcttttctttaagttcggcgctgcgtttggcgtcaatgcccgggatgctggcacgccagaaggtacccatagttttgccttcaagaacggtaacttcagtagcgtgggttttggcgggttgtggtttttgatcgcaaccaacaaagaagagcgcggcagccagcagtgccacgcgggtaaagcttatttccatacgtgattatcctcatgcgaacggtcgcaagagtacaccaaaaaactgagtttgtacgctgaaaacaatgaaaaaagggcccgcaggccctttgttcgatatcaatcgagattagaactggtaaaccagacccagagctacgatgttatcagtgttgatgccagcgtcacgagtgaactggttgtcgtccagcaggttgattttgtagtcaacgtaggtggacatgtttttgttgaagtagtaggtagcaccaacatcaacatatttcaggatatcttcgtcgtcgtagccacgacccaggtttttacctttagactgcaggtaagccagggacggacgcagaccgaagtcgaactggtactgagcaacagcttcgaagttctgtgctttgttcgcccaacccagggaacctacgcgagttgcgttgtaggtctgggtgtactgagcagccaggtagatgttgttagcgtcgtatttcagaccaccagtgtaggtttcagcacggtcgccgttaccgatgtaagcagcggtgttctgagcatcagtacgtttggagctggagatcgcaccaccgataccgaaaccttcgtaatcataagtgatagaaccgccgacgccgtcgccgttttgacgcagtgcgtcacgaccgttgttagttacgccactagtaaagccttcaccagatgggttgccgtttttaccctggtactgaacagcaaagttcaggccgtcaaccagaccgaagaagtcagtgttacggtaggtcgcgaagccgttaccacgctgctgcatgaagttgtcagaaccgtaggtgtcaccaccgaattctggcagtacgtcggtccaggaagttacgtcataaacaacgccgtagttacgaccgtagtcgaaagaacccacatcctggaatttcagacctgcgaatgccacacgggtccaggagttgttttcgttttcagcgctgttgccctggatctgatattcccactggccgtaaccggtcagctggtcagtaacctgagtttcacctttgaagccaagacgcatgtaggtctggtcgccatctacatctttgttgtcagagaaatagtgcaggccgtctactttaccgtacagatctaatttgttgccgtctttgttgtaaacttcagcagcgtttgctgcgcctgctaccagcagagctgggaccaggagggacagtactttaactttcatgttattaaccctctgttatatgcctttatttgcttttttatgccactgcatactgattaaccctcattaatcagtcggcaagtccattctccccaaaaatgcagaataatccaacacgaatatgatactaaaacttttaagatgtttcatttatcgctatagatgtttcaaaatgtaaatgcaagggaactttttaagattattgcggaatggcgaaataagcacctaacatcaagcaataataattcaaggttaaaatcaataacttattcttaagtatttgacagcactgaatgtcaaaacaaaaccttcactcgcaactagaataactcccgctatcatcattaactttatttattaccgtcattcatttctgaatgtctgtttacccctatttcaaccggatgcctcgcattcggttttttttacccttctttacacacttttcattattctgtgctaccacagaaaaactataacgcttgttaactatttcacaaataattaacatccgcataatttccagcaatctttgtttatttgcaattatttttgttgggctttttgtaggttatttgtacagcaaaatggcgcttgtacatctatttcccccaatgcaggatgataaatatcacgggagaatagagaatcatcaatcaggtaagagtctggaatttcacactgtaccctttatactgccctatcacttcgcgaagttttaacaggtcataaacacgaatgcgtcagaaagagacaacggccacgacccgcttttcactcctaccggggagcattacccgcttctttttactgttgatcattgtgttactggtgacgatgggtgtaatggtacaaagcgccgttaacgcctggctgaaagataaaagttaccagattgtcgacattacccatgctatccaaaagcgcgtcgataactggcgttacgtgacctggcagatctacgacaacattgccgcgacgacctccccctcctccggcgaaggtttacaagagacgcgcctgaaacaggatgtctactatctggagaaaccacgccgcaaaacggaagcgttaatctttggctctcacgacaactcaacgcttgagatgactcagcggatgtccacttatctggatacattgtggggcgcagaaaatgtaccgtggtcgatgtattacctgaatggtcaggataacagtctggtgctgatctcaaccctaccccttaaagatctcacctccggatttaaagaatcgaccgtcagcgacattgttgattcacgtcgtgcagagatgttgcaacaggccaacgccctcgatgaacgcgaaagcttttctaacatgcgccgcctggcctggcagaacggtcattactttacattgcgtactacctttaaccagccaggacatctggcaacggtcgtggcttttgatctgccgattaatgatttgatcccaccgggtatgccgctggacagtttccgccttgagccagacgcgacggcaacgggaaacaatgataatgagaaagaagggacggatagcgtcagtatccactttaacagtacgaagattgaaatctcctcggcactcaactctaccgatatgcgcctggtctggcaggttccttatggcaccttattgctggatacgttgcaaaacattctgctgccactgctgctgaacatcggtttgctggcgctggcgttatttggctataccacattccgccatttctccagccgcagtacagaaaacgtccccagcacggcggtcaataacgaattgcgcattttacgggcaatcaatgaagagatagtctcactgctgccgctcggcctgctggttcacgatcaggaatcgaaccgcactgtcataagtaacaaaattgccgatcatttgctgccgcatttgaatctgcaaaacatcaccaccatggcggaacagcatcaggggattattcaggcgacgatcaataacgagctgtatgagatccgcatgttccgcagccaggtcgcgccgcgcacacaaattttcattattcgcgatcaggatcgcgaagtgctggtaaacaagaaactcaagcaggcgcagcgtctgtatgagaaaaaccagcaggggcggatgatctttatgaaaaacattggcgatgcgctgaaagaacccgcacagtccctggcggagagcgcggctaaactcaacgccccggaaagcaaacaactggcgaatcaggcagatgtgctggtgcggctggttgatgaaatacagttagcgaacatgcttgcggatgatagctggaaaagtgagacggtgctgttctccgtgcaggatttaattgatgaagttgtgccttcagtgttgcctgccatcaagcgtaaaggtctgcaactgctgattaacaatcatctgaaagcacacgatatgcgccgcggcgatcgcgatgccttacgacgtattttgctgctactgatgcaatatgccgtgacctcaacgcaattgggaaaaatcacccttgaggttgatcaggatgagtcctccgaagaccgcctgacgttccgcattctggacacgggagaaggcgtaagtattcatgaaatggataatttgcacttcccgtttatcaaccagacccaaaacgatcgctatggcaaggcggacccgctggcattctggctgagcgatcaactggcacgtaaactgggcggtcatttaaacatcaaaacgcgggatgggcttggtacacgctactctgtgcatatcaaaatgctcgcagctgacccggaagttgaagaggaagaagagcgtttactggatgatgtctgcgtaatggtggatgttacttcggcagaaattcggaatattgtcactcgccagttagaaaattggggtgcaacctgtatcacacccgatgaaagattaattagtcaagattatgatatctttttaacggataatccgtctaatcttactgcctctggcttgcttttaagcgatgatgagtctggcgtacgggaaattgggcctggtcaattgtgcgtcaacttcaatatgagcaacgctatgcaggaagcggtcttacaattaattgaagtgcaactggcgcaggaagaggtgacagaatcgcctctgggcggagatgaaaatgcgcaactccatgccagcggctattatgcgctctttgtagacacagtaccggatgatgttaagaggctgtatactgaagcagcaaccagtgactttgctgcgttagcccaaacggctcatcgtcttaaaggcgtatttgccatgctaaatctggtacccggcaagcagttatgtgaaacgctggaacatctgattcgtgagaaggatgttccaggaatagaaaaatacatcagcgacattgacagttatgtcaagagcttgctgtagcaaggtagcctattacatgaacaatatgaacgtaattattgccgatgaccatccgatagtcttgttcggtattcgcaaatcacttgagcaaattgagtgggtgaatgttgtcggcgaatttgaagactctacagcactgatcaacaacctgccgaaactggatgcgcatgtgttgattaccgatctctccatgcctggcgataagtacggcgatggcattaccttaatcaagtacatcaagcgccatttcccaagcctgtcgatcattgttctgactatgaacaacaacccggcgattcttagtgcggtattggatctggatatcgaagggatcgtgctgaaacaaggtgcaccgaccgatctgccgaaagctctcgccgcgctgcagaaagggaagaaatttaccccggaaagcgtttctcgcctgttggaaaaaatcagtgctggtggttacggtgacaagcgtctctcgccaaaagagagtgaagttctgcgcctgtttgcggaaggcttcctggtgaccgagatcgctaaaaagctgaaccgcagtattaaaaccatcagtagccagaagaaatctgcgatgatgaagctgggtgtcgagaacgatatcgccctgctgaattatctctcttcagtgaccttaagtccggcagataaagactaatcacctgtaggccagataagacgcgttagtgtcttatctggcatttgcaccgattgccggatgcggcgtaaacgccttatccggcctacgattcccattatttcaacaaattacattaaagtaggccagataagacgcgtcagcgtcgcatctggcatttgcactgaatgccggatgcggcgtaaacgccttatccgtcctacgaatcccgcgatttcctgaccctctcggcatataacgtcagcgtctgttttatcacatccagcgttaccggcttcgacaggcagctgtccataccggactccagacaccgctgcttctcttcagccaacgcattagcagttactccgattaccggcaacgtcagtcccaactgacgaatgcgttgcgtcaagcggtaaccatccatatttggcatgttgacgtcgctaagcacgatatcaatatgattcttgctaagtacattaagcgcatcgacgccatcattcgcggttttacattgatagcccaacgatcccaactgatctgccagcaaacgccggttaatcggatgatcatccacgaccagaatcatcatatcgtcattatcgctgaccgctttgtccgttgacggcagagcgttagcaggatcgtcgctctccatctcgatcaaataaatacgcgccaacaatgccggtagctcatgcggagcagccacactgtgtacccactcccctggcgctttctccagcggaataccaatatggcgacgacagaaggtcactaccgctctgccctgccattttttactcactacctcgtcagtgatcaacacatcttcgggagtcggttcctgcccttcgtatgttgtaacgacgatgccgctgcgctgcaaactggtttccaggaactgacagagcgacgcattgcggaccgccagccagcagcgtttaccactcaacccttccacgccttttttctgcgggtactgagcgccgtacaacggaatacgcacggtaaactggctgcccattcccggttctgaatctaccgagatatcgccgtccatcatgctgatcagtttttcacaaatcgccagacccagaccggtcccctggaaattacgctgtacgcccgttccgacctggaagaagggatcaaacaagcgcaccacttctttcgccggtatccccacgccggtatcgcgaacacggatagagagataatcgccatccgcgcgaacatgcaaaactatacagccggtatcggtgaattttatggcgttactcaacaggttggagatgacctgctgtaaacgcatcgggtcgccatttaaggccactggcacatccggttcaataaagcagtacaagcctaactgcttgcgtaccaccagcggtaaatagttggcggtgatgtggttcatcacttcacgcggtgaaaactcacgcggttcgatcttcaactgttccgattcaatcttcgagaaatcgagaatatcgctgataattttcaacaacaggctggaagagttgttcattgccgtcaccagccgatcgacgcctttcggtaactctttggtttgcaacagatccaggttaccgataatgccatacagcggcgttcgcagctcatgactgacggtggcaaggaacatcgattttgactggctcgcctgttccgctgcttgtgccatctcctgcaacgactcttccatcttcacgcgcgaagaaacatccaccagcacacaaatggccacgttttcattacgatagcgcgaatggacgaagctgatttgcagattggtattgttgctggtcaggacatcaacaaaattgacctgctgcccacagataatttgcgtcagtcgttggcggtcctcatgcgtaagcatattgagataggtatgcgccagttcgttacttaaaatattgacgccatcagcggtacgcaaaatgcagatacccactggcgcggaggcgacaatcttgcgattgaactgctcatgttcttccagtcgcagggcgtcgctttccgccggaatgaaaatacgtcgctcgtacatccgtgcgagagtaaacaatgcagctccggcaagcacattcagcaaaattgcgttaaggatcaacatgcgaatgcgttccagcaccttatcaaccggcaccgaatacacgatgcttagcgatgagggtggcagatttttcttcagcaccagctcccggaacccttccgtatagccaaaccaggagcgttcctgcatccagcgaggatcgcccttaattttactttctggtccggtaagcgaaatcagggtatgaccattttcatcaagaatggtaacccccatcggcaacgtacccggtaagaaaaagttctccatccggatggtctgctcgacacccaaaagcgcctgcaaccggttcgccagataaactggcgtcaacgcgtaaaaatacccgacgccagggcgcggaccttcgctgatccagtagaggttactgccgctatcatcttgtggtgcatttcgatatttattgatgcgttcatgcaaagctttcaacgcggtatcgcgttccactggcatatcacgcagaccgaaattggccatgcagaggttatcgctgccgattaaaaatacccggtttagatcgtaagccgcagaaaaattatcgcgccagtagcgcataaaccacgccaatgactccagagaacctcgccaggtgttactcattgcggaacaatcggagtcggcaaacagcggttcaaacgcaggcacatccgcctgcgtttctcgtccacgcggggaaagcacaccgttttctgccgataagcgattttcggcgatgtacttcagctctttcatcacatcagaggtgcgttgaataaagcgctgagcctgatcggaactcagattaaattcctgacgaatttccgattctcgctgatgtaacgcattaacgatgtaaaaaacggatgaaaaagcaatcaacagccagagcactaacgccaatgctctgaacatgtagcgcgaggctttcagggttgtacgaaaagaagcaaggtatttcaaaggggcgaagctccgcctcaggtgaccgatggagtgtggttaaggtagcggtaaaagcgtgttaccgcaatgttctctcttctctggaatatgatacaccgccgagaaatcatcaccttaacctctgataatcgtcatataccggacaagactagtggatttcagcatgcattatatgaagtggatttatccacgccgcttacgcaatcaaatgatcctgatggcaatcctgatggtcattgtcccaacgcttactattggttatatcgtagaaacggaaggacgttcagcagtcttatctgaaaaagagaaaaaactttctgccgtggtcaacctgcttaatcaggcactaggcgatcgctatgatctctacatcgacttaccacgtgaggagcgtatccgcgcattaaatgcagaacttgcccccattaccgaaaatatcactcacgccttccctggcatcggtgctggttattacaacaaaatgctggatgcgataatcacctacgcgccttcagcgctatatcagaataatgtcggcgttaccattgccgcagatcaccctggtcgcgaagtgatgcgtacaaatacccctttagtttattcaggcaggcaggtgcgcggcgatattttgaattcaatgctccccattgagcgtaatggtgaaatcctcggctatatctgggccaatgaattaaccgaagatattcgccgccaggcctggaaaatggatgtgaggattatcattgtgctcaccgctggtttgctgataagcctgctgttgattgtccttttctcccgtcgcctgagcgccaatattgatatcatcaccgatggcctctcgactctggcacaaaatattcccactcgattaccacaattgcccggtgaaatggggcaaatcagtcagagtgttaataacctcgcccaggcactgcgtgaaacgcggacacttaacgatctgattattgaaaacgctgccgatggcgtcattgccattgaccgccagggtgatgtaaccaccatgaacccagcagcagaagttatcactggctatcaacgccatgaactggtagggcagccttactccatgttgttcgacaatactcagttctacagtccagtactggatacgctggaacatggcaccgaacatgtggcgctggagatcagttttccaggtcgtgaccgcaccattgaactcagtgtcactaccagtcgtattcataacacgcacggtgaaatgataggtgctttggtgattttctctgatttaactgcccgcaaagaaacccagcgccgcatggcgcaagcagaacgcctcgccacactgggtgagctgatggctggcgtcgcgcatgaagtacgtaatccgttaacggctattcgtggttatgtacagatcttgcgccaacaaaccagtgacccaatacatcaggaatatctgtccgtagtactcaaagaaatcgattcaattaacaaagttattcagcaattgctcgaattttcacgtccacgccacagtcaatggcaacaagtcagcctcaatgcattggttgaagaaactctggtactggtacaaaccgccggcgtacaagcgcgggtcgacttcataagcgaactggataatgaattaagcccgattaacgccgatcgtgaactgctcaaacaggtactactgaatatcctgatcaatgccgtccaggctatcagcgcacgagggaaaattcgcattcaaacctggcaatacagcgactcacaacaggccatttcgatagaggacaacggctgtggcattgatctctcgctgcaaaaaaagatcttcgatccctttttcaccaccaaagcctcaggaaccgggcttggtctggcgttaagtcaacgcatcattaatgcccatcagggtgatattcgcgtcgccagtttgccgggctacggcgcaaccttcacgcttattttaccgatcaacccgcagggaaatcagactgtatgactgctattaatcgcatccttattgtggatgatgaagataatgttcgccgtatgctgagcaccgcttttgcactacaaggattcgaaacacattgtgcgaacaacggacgcacagcattacacctgtttgccgatattcaccctgatgtggtgttgatggatatccgcatgccagagatggacggcatcaaggcactaaaggagatgcgcagccatgagacccggacacccgttattctgatgacggcctatgcggaagtggaaaccgccgtcgaagcgctacgctgcggagccttcgactatgttattaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgagccaacgaaggtactctgctcctcgacgaaattggcgaaatgccgctggtactacaagccaaattactacgcattctacaggaacgggaatttgaacggattggcggccatcagaccataaaagttgatatccgcatcattgctgccaccaaccgcgacttgcaggcaatggtaaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccgggaaatattcgagagctttccaacgttattgaacgcgccgtcgtgatgaattcaggcccgatcattttttctgaggatcttccgccacagattcgtcagccagtctgtaatgctggcgaggtaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataacaccaaaacttgctatgcagaaatttgcacagtgcgcaattttctgcatagccgctcattctccttataaatccccatccaatttatcccttcatattcaattagttaaataactaaatccaataatctcattctggcactccccttgctattgcctgactgtacccacaacggtgtatgcaagagggataaaaaatgaaaacaaaattgatgacattacaagacgccaccggcttctttcgtgacggcatgaccatcatggtgggcggatttatggggattggcactccatcccgcctggttgaagcattactggaatctggtgttcgcgacctgacattgatagccaatgataccgcgtttgttgataccggcatcggtccgctcatcgtcaatggtcgagtccgcaaagtgattgcttcacatatcggcaccaacccggaaacaggtcggcgcatgatatctggtgagatggacgtcgttctggtgccgcaaggtacgctaatcgagcaaattcgctgtggtggagctggacttggtggttttctcaccccaacgggtgtcggcaccgtcgtagaggaaggcaaacagacactgacactcgacggtaaaacctggctgctcgaacgcccactgcgcgccgacctggcgctaattcgcgctcatcgttgcgacacacttggcaacctgacctatcaacttagcgcccgcaactttaaccccctgatagcccttgcggctgatatcacgctggtagagccagatgaactggtcgaaaccggcgagctgcaacctgaccatattgtcacccctggtgccgttatcgaccacatcatcgtttcacaggagagcaaataatggatgcgaaacaacgtattgcgcgccgtgtggcgcaagagcttcgtgatggtgacatcgttaacttagggatcggtttacccacaatggtcgccaattatttaccggagggtattcatatcactctgcaatcggaaaacggcttcctcggtttaggcccggtcacgacagcgcatccagatctggtgaacgctggcgggcaaccgtgcggtgttttacccggtgcagccatgtttgatagcgccatgtcatttgcgctaatccgtggcggtcatattgatgcctgcgtgctcggcggtttgcaagtagacgaagaagcaaacctcgcgaactgggtagtgcctgggaaaatggtgcccggtatgggtggcgcgatggatctggtgaccgggtcgcgcaaagtgatcatcgccatggaacattgcgccaaagatggttcagcaaaaattttgcgccgctgcaccatgccactcactgcgcaacatgcggtgcatatgctggttactgaactggctgtctttcgttttattgacggcaaaatgtggctcaccgaaattgccgacgggtgtgatttagccaccgtgcgtgccaaaacagaagctcggtttgaagtcgccgccgatctgaatacgcaacggggtgatttatgattggtcgcatatcgcgttttatgacgcgttttgtcagccggtggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctctgctccggtgaaaagtttgctgcgtactgccgcctccgccgcaaagacgcccgtacagggcgtcatgctggtcactttcttcggttcagtcgcttgtgtcatcaactggggatttggtttggttgtcggcgcaatgtttgcccgtgaagtcgcccggcgagtccccggttctgattatccgttgctcattgcctgcgcctacattggttttctcacctggggtggcggcttctctggatcaatgcctctgttggctgcaacaccgggcaacccggttgagcatatcgccgggctgatcccggtgggcgatactctgttcagtggttttaacattttcatcactgtggcgttgattgtggtgatgccatttatcacccgcatgatgatgccaaaaccgtctgacgtggtgagtatcgatccaaaactactcatggaagaggctgattttcaaaagcagctaccgaaagatgccccaccatccgagcgactggaagaaagccgcattctgacgttgatcatcggcgcactcggtatcgcttaccttgcgatgtacttcagcgaacatggcttcaacatcaccatcaataccgtcaacctgatgtttatgattgcgggtctgctgctacataaaacgccaatggcttatatgcgtgctatcagcgcggcagcacgcagtactgccggtattctggtgcaattccccttctacgctgggatccaactgatgatggagcattccggtctgggcggactcattaccgaattcttcatcaatgttgcgaacaaagacaccttcccggtaatgaccttttttagttctgcactgattaacttcgccgttccgtctggcggcggtcactgggttattcagggacctttcgtgatacccgcagcccaggcgctgggcgctgatctcggtaaatcggtaatggcgatcgcctacggcgagcaatggatgaacatggcacaaccattctgggcgctgccagcactggcaatcgccggactcggtgtccgcgacatcatgggctactgcatcactgccctgctcttctccggtgtcattttcgtcattggtttaacgctgttctgacggcacccctacaaacagaaggaatataaaatgaaaaattgtgtcatcgtcagtgcggtacgtactgctatcggtagttttaacggttcactcgcttccaccagcgccatcgacctgggggcgacagtaattaaagccgccattgaacgtgcaaaaatcgattcacaacacgttgatgaagtgattatgggtaacgtgttacaagccgggctggggcaaaatccggcgcgtcaggcactgttaaaaagcgggctggcagaaacggtgtgcggattcacggtcaataaagtatgtggttcgggtcttaaaagtgtggcgcttgccgcccaggccattcaggcaggtcaggcgcagagcattgtggcggggggtatggaaaatatgagtttagccccctacttactcgatgcaaaagcacgctctggttatcgtcttggagacggacaggtttatgacgtaatcctgcgcgatggcctgatgtgcgccacccatggttatcatatggggattaccgccgaaaacgtggctaaagagtacggaattacccgtgaaatgcaggatgaactggcgctacattcacagcgtaaagcggcagccgcaattgagtccggtgcttttacagccgaaatcgtcccggtaaatgttgtcactcgaaagaaaaccttcgtcttcagtcaagacgaattcccgaaagcgaattcaacggctgaagcgttaggtgcattgcgcccggccttcgataaagcaggaacagtcaccgctgggaacgcgtctggtattaacgacggtgctgccgctctggtgattatggaagaatctgcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaacctgggctttgattctgagaaagtgaatgtcaacggcggggccatcgcgctcgggcatcctatcggtgccagtggtgctcgtattctggtcacactattacatgccatgcaggcacgcgataaaacgctggggctggcaacactgtgcattggcggcggtcagggaattgcgatggtgattgaacggttgaattaatcaataaaaacacccgatagcgaaagttatcgggtgttttcttgaacatcgacggcgaaggtaaccccattaatcaccagtcaaaacttttcaccagcgtcagctcgccagcattacgcatcggtacaataaatgtttcctgtttctcattgaccgatccttcatcggtgatcagcgtcagttgggcggtggttaattccgtttcgctgcgcccaccatagtagttgatatacacctgatagcgcccgtgaattggcgcgggcatggcgaaaatctcgggtccgtaccccgtcgtgacatccatatccagtgcaccactgtttttcagcacggtgttaccgtaccaggcgtgttcgccatcgggcgtaacaacgtgaaggtcgaggtcggtattgtccgtatcccacgagagaaccagccgtaaacgtgcacgaatcgttcctgtacccggcgttgagtaaaactgcattttttgtcggctttgcccatccgggctgatgacctgcacgctgttgctgccttcagtgaaaatataagggcgtgcaaatgaaccatcggattcaattctctgcggcatactggcaccgttgaccaccagccggccctgctgaactttacccgccgcagcataattctttattttgccgcggatctgcgctgagatattttgatcatctgccatgttgacggacgacgccgggtaattgatcgattgtgaaaaactggcatcttcgccctctgccggatgccagcctgagagcggtgcatcaatctcgacttcctgcacaccttcactgtgagcgacaggcgaaagcgccaccagtaacaacggaagaaaaatctttcgcatagcattagtccattaataattgtcgggtcagcgtttcgatatagttctcatcaagcccggtgggataaccatcaaaggccaggtgcagatactcatgggttaaatccagccgatcctgaagcgtaaagaagttacgaataaacagccgtttctgctgccgatcggtataggggaaacctgagactaaacggcaaaccgcaaacacgtctggttcgttgtaccccgtctcagcttgtaatatacgccgccactgcggcatttttttcgccagccaggctttcgctttgggtaataactggcaggttgagcgtggcgctccccagcggctaagactgttgtcgggataagcaaacgcgagtatctgatcgtaacgctctccctgccccgcctgggccgtggcttgccgccaggaaagtgtcccttcggtagcgcgactgccatgataatgaaccggatcgcctgcatagatgagatcctgcgtccaggcggtcatcgttcgcgcccccgtggtcgctggcgaagcagaaacacgctgcgtggcgctgctgtcggggatggtcaggcaatcgccttcccgattggcgttttgctgtaaaaaagtgcgaatcgccacggtcatggctttcgctgcctcagggggcgtacttttcgcctcgcgatccagaactctggcaacgtactcttcacgatcgagatgcgactgcaatttcagtttgcccttttcgctcagtaaggtcgtctcaccgtggctgacaaacgtaatgtggttaccattagtaaacgtcacacgatagcgcccattaagtacgccgggatttactgccgtcgtactcttttccgctgtgattttcttcagcggatagcgggcaaacagctccacctctacacattgcccactggcaacctgcgtcggcactggcaaaacccgattaagcaccgtcgcataacgggttagtaccgttttgctggtgccactgccagtaacccacagcggtgtaccatcggttaaccagccagcaaaaccaccctgacggatttcctgtttatcatcggcaaaccagctccaggttttcacccgtacccgactaccgagcatggatgcgacaccgattttcgcctcgtccagcaccacatccagtaagacttcctgagctttgttttgcgcgggtaacgtcgctaatgaatcaagcagcgatttaaccgttaccgaggtttctggcttcagcgtagtcagagacgctaaccacgcaggtgcctgacgctgttgccagtattgcccccacacatctgcgccaatatgcaaccgctgcggcgcaaaatagagcccacaggaacgtaccagcgcggtatcgcgcgttatgctctccccagcctgacaacaataaacctcttccggggagtttccgcgacactggtagggctgctccggttgatgggtatcctccagccaggcgtaaacatacagtttccacaaactccctaacggcgtggtgagcgagtcaggtaatgctgagactttggtcacgcctgatgacgacagctgatacagttgatcgtgctgcgcaccgcgcagcaccagttgtaacggcgtctcctccgcaagtgttggcagagtaaccaacgccaatagccagacgattctgcgccagttcacttatttcacctgcatcccggtccattcactccctgccgcaacactttgctgcgcaggtgcataggaacgcacataacgagcaggaggcagaacgaattgccctttttgcgagaagcgcagcaaatggcggaaagtgaccgttcccgtcagttctttcaccggcaccatataggccagttcgcccatttcatttcgcgctttttccagcaattgcccctgctgtttcgcggcgttgggtttattgaccgaaatgccccatgttgtgcgctcaacgtcggctcccggtggcagcggtacttccacctgaccgtagcgcagaactgcatcctgctcgctggtaagcgtgatttcatcgagatacagcgcatcgctgtcaatctcattgctggtcaccggttgcagaataaagctcatctcttcttcaccagggataagccgatacaactggcgttcaacggtcaccggaatgttactttgttgagccatttttgccggctcacgtcagcggacctgcacattttgcggcgataattcgtcaccaaaagagagaatgtccggcacgccctgaccaacccaacgccagtcttcgccccctccagttaacttatgtttagcccatgcgcccgcaggcgcaggcaaaacaactggaggcattgtcgccatatatttcgccagccagttcatggccagcgcgcgctcaatagtggattgctcagcggtcaaaccacttaaaatagcggccgtctgggtagcgtcgccaccgctattaagcagcacaaccgtgtgcgccagcggctgattgctgtttgccgctttatcccacgcatattgctgaacctgtggcatcaccgtggacttcaactgcgcttttttcagcaacgtcatggttaagacgtttgccaccgcatctgccagtggagactccggtgtatcgaggatcaggctatcattgatatcgcgggtgtcttcctcagagaaatcttcagttttagttccgcgccgggcgatagcttcatccaaccctttcaacaacgttttgcacggcaaattcatctcctgcgcccatgccagcaccagcgcccgatgcaataacggcatgttatctgcctgctccgcgtagctgtcgagcatatgctgccagtattccggttgttgcgttacgccgatcgcctggctggcctgccagtcggcgtaccatgcccatgccgtaaggaaggcgtcaccattgccatcttcaccccaccaggtaaagcgcgctccgggccccgccagttgcatcagccgcagacggttatcctgaatcatctgacgaatgtcgttagcggcggcactttgatgatcggcaagcgaacgccaggcgagactgagcgggatcagacggctaccggtgttgattacgccaccccacggttcatcgactaacgcatcaagattgttgcggaaaatctcctgcggcgtttcactactttgtagccggatattgctcgcctgctcgggcaacatcagcgcgttatcgccaccaccgagcatgacatttttctgctgttcaacgggccagctgttatccacaaaagacagttttgtgctaatgctgtcctgcacttgcccattttgttgcagttctgcacttaacaagccagattgctgaatattctgcgtcagcgaaatataattcgcccctttgtgcagcgtcagcgtctggcgcatctcagcgcctgcaaatttagtcaccagcgccaccggttcgttatcctgctgactgaagataaacagtcctgccgccggtttgtcgcccacgcgatacaccgttggcatactccacttcatgtagagatttttttccgaacgcagataagcacgcccctgcccgaccagcccgtcgccgttcatcccacgcgcggtgatacgccagcgggttaacgaatcaggcatcaggaacgtgaaatacgctttgccttgtttatcggttgtgagtgacggcatccatgccgcggtatccacctcttcacgccgtggacgttcaagcatttttactcgccgctcgctgcggttagttgcgccaggcgcaaccggctcgctggagagcgcctggtcgtagctgataaacgacagactggagctggtacgcacattgttacgccccagcggatagaaaaatttgccgatattcggcgcgatttctggttgcagcgcgtagatcatttcatcgaccacgcctaccgttagctgcgcagaaacaggtttacctttcagcgacgaggttaattcgacattgaccagttcaccaggctggtaatgggttttgtccgttttcacccggatatccagctggggaacggcaactttgatcccggcgttctgaaaactgtactgaccgttacgggtatacagcaccgaaaaagtgatgttaggcgcaaaggaattgctcactggaacccgggcttcatactgggtatcgtttaaacgttgtagcgttagccagtttgccggatgcgaaagcagcgactgctgttccacgcgatcgcgttccagcgtcaataatgcttcatcaattggctccggaaaggtaatcagcatcttcgcggtttcgcctggctggtacagcgttttatccgccacgatatctaccgtaccagtatgcgccgtgctgcccttaccgctgacggcatgacttaacccagcgagaattaagccgtctttatcgcgtaatgtcagattgtagttgccaggtttagcgaaattgacggtaaaggatttgccgcctgacggtagctctccgctatggctcgtgcggtcttcgagacgcaaccattcatacgtaacaggaacctgttttgaagattccagcgcggcataacggaacacaaccgactcgccgctattactgtattgtgcggcagtacttaatgagtaatgcgccagaccgcgttcaatgaggatctctttggtggtggtgacgcgatacgccgcgccgtcactggcggagacggttaacaaatagcggctcggtttatcggcggcggggagatttaacgccacatgaccgctggcgtcggacaccgtttcgctgccttccagcgacacggggaaacgtccggcataacgcaaatcgttaccgaccattgataattgctgagcgcgcaaacttaactgcacgcgggcattttttaccggctcgccatccgggtagagcagttgcagtttgccgctgaccgcttcgccagttttgaactcttttttggcgagagctaaaccaatctcgaaatgtggcttgatgtagtttgccacgcgaaaactgctgctatagacctgattgcggtaagcaagacgtaactcataacctccggctacggcattttctggcaggcggaaacttccctgcccgccattgcgcgcatccagcgtgacattgacggtttgcaacagactgccgttggcgtccagcaccgaaagcttcgccggggcgctgacgatgggggatgaatgcaacggatcgtggaactcgcggccgatcactttaacatcgacacgatcgcctgcgcgatatagcgggcgatcggtaaaaatatacaagcgggtgttgtagatttcgctttcgtagaagaagttctcggagacaaaaacgccgccttcagcatccttacccagaatgtatgaacgttctggcgatatatgttgtaactgcaaggtaccgctgtcatcggtcacaccgcgggtcatcacgccaagaccgtcagtccacaagatctctgagccgggcttcgcttcaccctgttttttacccgcggtccacaccagaagctctttgcctgacactttgctaagcgccacggtatcggaaacaaacaccaccgtcgtcgcccgatacccaccaaccatcgcctcgacgaggtacagtcccggctcttgttggccgagaggaatataaatgttacccggctgcggcgagatgaaattgctggatgcgccttccagttttaccccttgctgcggctcgaacggtttagcctgccatagtggataacggaactgtttcaccaggggatattttttcagcggggaaaactggttgttctgtacataacgggaaggtttaataatggcattgccgagctgtaattcgggtaacgcctgagtcacattctgccgtgactgagaagagaaagtacgctgcatcacgcggcgagatttgccgtaccagttatcccacagccaggttagcgtattgttcagcccgtcgcccagatattgcggttgcaccacaatgcgatgcaggtttttctgctggcgcaaaaatgccatcgggtcaggaatacgatacaggcgaacgtccacgccgccgtactcttccatctgatagcgccgataatcacgccccggcgcttccagtcgcactttcgcctcttcactgctgctaaaactgctgtcagcaagcaaaaagaatgttcccccggcaggcggcgcatagttgctggaaggaagcgaatcatcagcattagcaagccctgttcccacaagagacagggacaagcacgctgctatcgcgccagaaaatttaaacgataaatgccaatgaaattgggattggaatcgttgggtatccatcgggtgtccttccatgtcataagttgttgcagactgactgcgcgcattccgttgtcagttttcgtggcgcttccggtgtggtagatgacgtaacgccccatccagaccattaagtgctgggcatcgccctgatcgaaaaaaatcatatcgccaggcagcgcctggtttatgtcctggccaataaactggctgttgtactgaatcaaattaatcgcggtcacataggggccggttttcccgttcccctgattccagttttgcgccagttgacgctgttcaggtgttagcgtcatctctggcggcaaatactggctagataaaccgttactttttagccatttactgtcgtgaactttcagcgtctcgttcgccgcaaatcgcaccaggcccgcacaatcctgctgataccagcgtggacttggcccctggcggagctgttcttgtgcaatgcgtacaaaccaggcgcgaaacagcccggattgttcgacattcagcatttcgctatgggcaacaacacaacacagccagcaaatcagcgccagcagcccgtgcctcatagcggctgccaggttatgggtagccactgccaggcggcaccgggttccatctgggccagcttcatgacataacgcggttgttgagataaagcgtccagcttcggcattaataaagtttgtgcggcgttataaaaaaccggttcgagattcttcggcagactggtcaacgtttcgttacgcagcagtttcgctattccttgtggattgatatagagcggaacgatgccatcagtgggtattacatccaccattgccgggcgggttttattcagtgtttgcagcgcgttattaaccagcgtgtcatcgagggagaaaagcagcgttttgttttgcatcgccagcgacacacggaaaaaataatccgacattaattgatcgggttgcgccgcctgcgctttcggatactggccgtatcgggaactcacttcgcgacgccagatttgcgcttcgccctgctgagtctggcttaccggcaaaacaccttctggcgctttgctttcgtgcgcaccaatattttgcgtaaacagtttccctggcaattgcgcctgttcggcagtgccatcaaactgaccgacaaacagcggggtttgcaattttgagtcttcataccagcacagccccgcggcaccgtctaacgccccattcagcttgtcgttttcctggctgatgtgcgaaagcatctcttcggcaataccgtgtgaatacggcaccgccacacagaagctggctccggcaggcatactgttccataccggcgtaaaatcgaaactggcatctacgctggcggattcatcatttaacgccacaaaactgtgccagccgtcgttacccatttcgaagcgtacgccagcaaaagaaggcattaaccgctggtagccaaaccccagccacctggcgctgactacgatgcgctggcgtactggcgttttttcggcagtacgctcttccaggccaaagcttgcttgccagcgttttttgccgctcaacaaatcacctgcgatcgccgtggcttcggtatcctgctgatcatctttaaacaacatatccgtgctggaaaacaccagcatcttgtcctgataagtcgcgaacatcagggcgttattgccgttatagcgcaactgataaacaggaacagtttcactatttatcttgatgctactgatttccgttttgcttaactggctgtcgctggtagcggcaaacaacaatggctccagcagtttgcttaaaccactgcgctggatcagcaccatataatgtgaaagatggccttgtttatcgtgccacagcgctgcctgcgcgggctgatctaagagtgacgaaaagagcttatctttcagcgtgagatcgtgttcatagacaatacgacgaatgctgccttcaatgcccagacgatcggcatgattctgataatagaaaacgaaatcttcgctcagaacatcgtggagaaacggaatggtgaggagatctttgggaagctggctcagagagtcgctgtcgagaaagaggtccggctcattgagatcgatttgcagattgttgtgcaccaccagcggcgacaacgttttttctggcccactgccagcatattgcaacgcccagacgccagcggaaagcagtgctattgcgccaaaacctacaagaccatagaaccgccagcctttcgcctttttttcaccactcattgccacattccttgtgtatagccagccattttttacgggcacagccaaactttaccgtgccctaatacgacaaaagcccagactttgcagcctggacttttcaattcaaacaagggagatagctcccttttggcatgaagaagtaaaattattcttcttctggctcgtcgtcaacgtccacttccggagcgatttcatcgtccccttccgcggcactgccgtcgatggtatccagatcttcctcgtcaaccggttcagcaacacgttgcagacccactacgttttcatcttccgcagtacggatgaggatcacgccctgggtgttacggcccacgatgctgatttccgaaacgcgagtacgtaccagcgtaccggcatcggtgatcatcatgatctggtcgcagtcatctacctgtaccgcgccaacaactaaaccgttacgttcggtaaccttgatggagataacccctttcgtcgcacgcgacttggttgggtattccgccactgcggtacgtttaccgtaaccgttttgcgttgcggtgaggattgcgccatcgccacgaggcacgatcagagagacgactttatcgccttcacctaagcgaataccgcgaacaccggtggtgttgcagcccatcgcacggacagaagactctttaaagcgcaccactttaccttcagcggagaacagcattacttcgtcttcgccgctggtcaggtcaacgccgatcagctcatcgccgtcaaccagtttgatcgccactttaccggcggtacgcagacggttgaactcggtgaggacagttttcttcacggtaccgttagcggtcgccatgaagactttcacgccttcttcaaactcggtcactggcaggatcgcagtgatacgttcgtcctgctccagcggcagcaggttgacgatcggacgaccgcgcgcgccacgagtggcttccggcaactgataaactttcatcgaatagacgcgaccacggctggagaagcacagaatatggtcgtgagtgttcgccaccagcagtcggtcgataaagtcttcttctttaatacgtgcggcagatttacctttcccgccacgacgctgcgcttcgtattcagaaagcggctgatacttaacgtagccctggtgagagagcgtcacgaccacatcttcctgggtgatcagatcttccaggttgatgtctgcgctgttggcggtgatttcagtacgacgtttgtcaccgaactgttcacgaaccagctccagctcttcacggatcacttccatcagacgatcggcgctaccaagaatacgcaacagttccgcgatctgatccagcagctctttgtattcgtcgagcagtttttcgtgctcaagaccggtcagtttctgcaaacgcagatccagaatcgcctgagcttgctgttcggtcaggtagtacagaccatcacgcacgccgaactctggctccagccattccggacgcgcagcatcgtcgccagcacgttcgagcatcgcggcaacgttgcccagctgccacggattagcaaccagcgcagttttcgcttctgcaggcgtcggcgcatgacggatcagttcgatgatcgggtcgatgttcgccagcgccacggctaatgcttcaaggatatgagcacgatcgcgagctttacgcagttcgaaaatagtacgacgggtcaccacttcacggcggtgacgaacaaacgccgcgatgatgtctttcaggttcatgatcttcggctgaccatggtgcaatgccaccatgttgataccgaaagaaacctgcaactgggtctgggagtagaggttgttgagcacaacttcaccgaccgcatcgcgtttcacttcaatcacgatgcgcataccgtctttgtcagactcgtcacgcagcgcgctgatgccttccacgcgtttttcttttaccagttccgcaatcttctcgatcaggcgcgctttgtttacctgatacggaatttcgtggacgataatggtttcacgaccggttttggcgtcaacttccacttctgcgcgagcgcggatatacaccttgccgcgaccggtacggtaagcttcttcaataccgcgacgaccgttaatgattgccgccgtcgggaagtccggccccgggatgtgttccatcagcccttcaatgctgatgtcttcatcatcaatatacgccagacaaccgttgatgacttccgtcaggttgtgcggcgggatgttggttgccatacctacggcgataccggaagaaccgttcaccagcaggttaggaattttggttggcatgacgtccggaattttttccgtgccgtcatagttatcaacgaaatcgaccgtctctttttcgagatcggccatcagttcatgggcaattttcgccagacggatttccgtataacgcattgccgccgcagagtcgccgtcgatagaaccgaagttaccctgaccgtctaccagcatataacgcagcgagaatggctgcgccatgcggacgatcgtgtcatagaccgccgagtcaccatggggatggtatttaccgattacgtcaccaacgacacgggcagattttttataggctttgttccagtcattgcctagtacgttcatggcgtaaagtacgcgacggtgtaccggcttcaggccatctcggacatctggcagcgcacggccaacaatgaccgacatcgcataatccagataggagctcttcagctcttcctcaatgttgaccggtgtaatttctctcgcaaggtcgctcatctaaccgctatccctctactgtatcccggattcaaaggtcgcaaattataacacagccgcgcagtttgaggtaaacctatacgctttattcacatccaatgcctgatatactcgtttgtcttgccaattacggagtagaagtgccaatgaatgccgaaaaatcgccggtaaaccataacgtagaccacgaagagatcgctaaatttgaagccgtcgcctcccgctggtgggatctggaaggtgagttcaaaccgctgcaccgcattaacccgctgcgtctgggctatattgccgagcgtgctggcggtttatttggcaaaaaggtgctcgatgtcggttgtggcggcggcattctggccgagagtatggcgcgcgaaggcgcgacggtgaccggtctggatatgggctttgagccattgcaggtggcaaaactgcacgcactggaaagcggcattcaggtggattacgtgcaggaaaccgtggaagagcacgcggcaaaacatgccgggcagtatgatgtggtgacctgcatggagatgctggagcacgtccccgatccgcagtcagtggtcagagcctgtgcgcaactggtgaaaccaggcggcgatgtctttttctcgacacttaaccgcaacggcaagtcatggctgatggcggtggttggtgcggaatatattttgcgcatggtgcccaaaggcacgcatgatgtgaagaagtttattaaaccggcagaattgctgggctgggtggatcagaccagtttaaaagagcggcatatcactgggctgcattacaacccgatcactaatacttttaaactcggccccggcgtggatgtgaactatatgctgcacacgcagaataagtgaggttgatgtttggccgcgccaatgcctgatgcgacgcttgccgcgtcttatcaggcctacaaatgctccccgtaggccggataaggcgtttacgccgcatccggcaaccgtgccgactagacagtgattaccatttcaccgtcatcgacaaaaaccctgccgtctgggcaaaatcatcactccctttctgccacgccacgctgccgcgcagggacactcgctgactgatattgcccgtgactcccacttttatttcaccccgttgcttcaccgcatcgtcactgatagtgctgccatcctcttcaatttccgtcgaatggggatcgtgataataattcagatctaatgttggtatgacatgaacagcggtacgccattcgctgtgtaaacccagccgcgtctgaatatcatcaccctgcgattgtgacacgcgcgcacggttagcggcggtaaaatcatcctgctgcacgccctgataaatcacctgcgcctgcggttcaatcaccacaccacgccccggtaaccactgataccccgcctccagcgaggcgataatccccgacgagtggtaatgatctgtgccatcttcttgttcggaaacatcattgctaaaccacgcgtattgcagccagctatccagccaggccccttgcttctgattaccgtgctgaaaccagcttgatgtcagcccaacggcataaccgtggttctggttatcggcgcgagttccggtcatattcgagcggctgtcgccctggttatcgctgtagccaccaacaatcccaagcatccactcgccatccgtgccccagcgcccgctaaacagatcgccgctaagttgcaccgtagaagtgtcttcatgttgagccagttgccccgctgctgtgtaatgataatctccgccgataacacgtaaattcagcgtctgaccatcgccacctgcgtgatcgcgtcgctccatcataaacgcctgatttgccgcccgcaggttattaagataaccgccaactttggcattcaacaccggctggtaagcaggcgtaggttccgggtcgggtgttggatcaggatccggcgtgggatcaggatcgggagtcgggtctggatcaggtggcgatggcggcgttacttcttgcgatcgcagataccagtcgttgttatcttccaccagcgtgtagtcatacgctcccatattgacgtagccgctgcctgccagactgaactgcgcattgttttgaaactgcgtgggatcagctgcgaaatcaaccactttaatgcctgtcgatgtcggctcaccaatccctgtaatggagttaaccaccacagttgtgttgccagcagtattaccgttcatcaccaattgatcgcttaccgagtcatcgccgtttaattcgctatcgagcagtagcgtaccgccgccggtataatcaccgtttaccgtcagcgtatcgccagcgacgccattttgcaggctaaccgcaccggacgtattggtcagattgccattaaccgtcacgttggaaagataagtcaggctgtcagtttcaaggttggtattaagctcacctgtcaacgtcacaccatcggtggcattcaccagcgtcccatcgccgttaaatagtgaggcattaagggcgacggaagtatcctgcccggtcaggcgcaaaaccgtaccatcgctgatgtcgatagtgccgctggaaatagcatcaattgactgaatatcctgatccgcgccagtaacgaacgttgccccatcaccaacccacagtgacgaagcataaggaaggatatcagcaacatcacctttcagggtgccttcttcgacacgtaccgccgactgcgttgtaccgctggcggtcagctccagtgtaccagcccccgttttagtcaatgtgctaccctcatcctgatgctgcccgctgctgtcagccatcagtgcgccccactgcgtgtctacccccgcatcaactgccacttcaccgtcggcgcgcatttcaatatcacgtccgtggcctgccgcatctgaacgcgtgtcaacgtcggaggtaatctccatcacgctttcttgttgcttatcggtaaagataacctggcggttatagtgggtatctccaagctgcgagttgtcgctcaccatcagcgtaccggaggcgatttgtgttgtgcccaaataactattattgtttgccagacttacctgcccgtcgctcgcatcgaccaccacgtagacgccatctttcccgtcgccgccgatatgcaaattgtcgccacctgcaagatctaccacatcctgactgccgataaccgttccgctgctgccactgacttcaaggccatcgttgtatgatgtgccgctctgccaggtggagaaatcagagagatcgagcacaccgccgtttaacacgatcgactgcggatcgtcctggagagcggtaagatctgccgcgtcgccttccagcgaaagcaccgcaccatcatcaacgactatatcgccggttagcgccatcgactgcgcccctgccagcacgtagctgccgttttgcgcaatggtgagctgaccagcaccttcgatgatgccagcaaaactgccctgattaacagtaacgttgccaccagcatcgatatttaaagtgccattctgaaagcccgtcaatgcgtgcacaaaagtttgttgggtcgagccaacgtttagctcagcctgattctgatactgatcaatactccctatcgtcagaccgtagcagtcttgcggatcgtcctggcaatgcgtatcgccgacattcatcagggagttgctgcggcccagggtaacttcaccgttttcaatctgcatctcaccagtaaagtcattgttatctgcattaagtaccagatcgccggaacctgttttggtgattaacccggtaccagcaatagagtcaacagctccgtcattctctgtattgccaataaccagcgtttttccgtcggcaatatcaaaggtaacttcacttaagccgagatacataaagccacccgccgcagaggaaggaccatctccatagcctgctgcgctattgttctcatcgactaacacgcctccgttctggctgtagctgtcatcaacagaaatatcaataagatagggagccgtcacgctattggtatatatcgccccgccataaccttcggcagtgttatttgtaaaggcagtgttatttactatcgtataacctgaaggatgcttgctgtcgctattattatcggtaacatcgattgccccgccatcgccatcactgtaacttgttgatgtatatgcctggttgttatcaaaaataacatcacttaaataaacgtcattattaatggtataaattgcgccacctttgccatcattagcgatgttattgcgaaacatggcgttagtgacacgtaaatcgacggcaccagtatcgttagtaccagaagaatagattgcgccaccatagccgcctgcgacgttaccggaaaaaataacatcagtaagattcagcgttgagttttctttagcaaatatggccccgccgttattatattctcctgtaacggtgttattggcaaacagagtcattccagtttcattttctggtaatagtgaaaattccgctccttgttgcaaaaatacggccccaccgctggcgttattggtcatatccgaaaaaaccagccattgcccatcagcgatactccagtcctgcgtaatgcctgaaaggctttgcctgctggcctgacaactcgctttgacatcatatccctggcatgaatcagtgaccgccgcgacaccgttagcagagaaaagagatgcaatcattgacgggagtaaagataaatactccttgcgtagaaagataatccgcatattaatctaaccatcattttctataagacggcgtatttaatcgcattatacgatatggaatatctttcttttgtaaattgttcaacccggtgcaatggctattttgttattatttgatgaataatatcagtgcgtcataattcaagttaataaccttcagggatatcagttatatttaaactaaattaaagtcatgaataattttcttataatataaggtaaattaacaaaatggcttagcatttaacaataaccgaatagaaaacaaccatttcgccatcaacaatctcttacattcgcttatatattgaccacaactgatacatcagattatgtgatgactcgtgcttagatcaatttttgcaatcattagcaaaaagattaataagccatctatatcaatttatctaacctattatgccgttcaagaaatcgccgaacagttatttttaacaaatttttctcttcccattgactttcccggacaccttgtctgacctaaggtgcgcgaaagccactttttccttcctgagttatccacaaagttatgcacttgcaagagggtcattttcacactatcttgcagtgaatcccaaacataccccctatatatagtgttctaagcagcttcccgtactacaggtagtctgcatgaaactattgcggaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgatggcccgcgttaccctgcgcatcactggcacacaactgctgtgccaggatgaacacccttcccttctggcggcgctggaatcccacaatgtggcggttgagtaccagtgtcgcgaaggttactgcggctcctgtcgcacacgcctggttgcaggtcaagttgactggattgccgaaccgttagcctttattcagccgggggaaattttgccctgttgttgccgggcaaaaggcgatattgaaatcgagatgtgaattggttgtagtgccagatacaacgcttatgcgtcttatctggcctacaacgattacatggcgtagtaatacgctttcacctgctcccagtccgctttggggattggctccagatatttttccagctggcggaagtcatgattaatcgctttatcgcgacgcaagcggcgacgacttttctccaggtcaagaaaaccagcttctgcattaccttctgttttcacatagatatggcgaacataacaacagccatgctgacgattaatgctatgcattttcttaaacgccagcgccactgctttcaacatggcttgccgtacttcgtcagaataaggcgatactgcatgctgggcataccagtcagcaatgctgatgaaccccgccatatcttcagtcaccagcaacgctcgccattcaccctcaattttcaccgcttcaccaaaaacgatcttcggcacgatgacaccggcccgttccagttctttaattaccgcaacctcacggacaatcgttggtcggccgaacggataacgtacggaatgaaacagatgatgcgtcatgcgctttacatacagctttttgccgttgcgctcgacgcattgcaccccgctcataccattacggcgatagttaggctcttcaacccagtcgccctctgttgcccaccagtgattaaattcgtcgtactttgctgaaactgccataccctatcgcctgtcatttttattaacgacaatgactataggtggttacctgaggaaaatcttaatgaaacgtgtcgtattaatgaatttcttttgccactactagcttgacaccgcttttacccttcatttgcagcgcatagattccaccagccactaccactaatagtgcgcccagcagataaaatgtgaatttaatcaggcggatacagcgatgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaatgtgcatggaacaattagtggcgattggaaaaatttgatatgagacaggatggcgcatgaacgccatcctgcagtaacattactctttattaagaaattttactgccttatcagggaaatcagtaaacagcccatttacacccgctttgttatacagagcatcatataactgattcacatcaggagtgtattcaggcagtttatctgaccgcacggtataaggatgcactaccagtttattctgctgagcatcttgcaccatgccagtgagtttgatattacccggctgcgatgtctcctcaatcaacatatggtaatccggaccaataccatctgcatattccgccacctgtttcatggcacccggcttaaacatccagtcgtagttgtaattaacccagcttccatccggctgtttctgctgcgtttcattccagtcggtataggcaatcagctgtaccagattgagctccatgcccattttgggttccagctcattcttaatacgcttcagctcatcagcatcaaaacattgcaaataaactttatcgtctttaccggtgtaaccatatttcttcagcacttccagcgtttttgccgcaatatccttcccttcctgatgatggaaccacggcgctttgatttctggataaataccgatatttttcccggtagagtgatttaacccctgaacaaattcaatctcttcttcaaaggtgtgcacccggaagtcggacttacccattgggaaacgccccggataagtctgcacttttttaccgttttcaatatcgaaaccttcggtaaatttcaacgacttaatttcatccagcgtgaaatctatcgcgtagtaacgaccgtctttgcgcgcccgatccgggaaacgatcggcaacatcagtaacacgatcgaggtaatggtcatgcagaacaaccagattgtcgtctttggtcatcaccaaatcctgttccagataatccgctccctgcgcatacgccatcgcttttgctggcagcgtatgctccggcaaatatccactggcaccgcgatgggcgatgactattttttcgttgctgtccgccgccattgcactgcttcccatgactatagtgctcatcatgatcgccatgctaaggtttttcagcgtcaatttcatgccattagcctccgttgcgttcttgcagtaattgttcatggcgacgtttttcgccaatcatcacaacaatcaacaagataaccgccagaatgctgccgccaatcattaccataaagccgccatcccagccgaagaagtccacggtgtagccaacaatcgcgctcgccgccaccgaaccgcccaggtaaccaaacagcccggtaaagcccgctgccgtacctgccgcttttttcggtgccagttccagcgcatgcagaccgatcagcatcacaggaccgtagatcaggaagccgataacaatcatacaaatcatatcgacggttgggttacctgccgggttcatccagtaaacgatagtcgcgatggtcaccagtgtcataaagaaaacgccggttgccccacggttgccacggaagactttatccgacatccagccgcacagcagagtgcccggaatacctgcatattcataaaggaagtaggcccaggaggatttatctagcgcgaaatgcttaacctctttcagataagtcggtgaccagtcgaggatgccgtaacgcagcagataaacgaacacgttggcgatggcgatataccacagcagtttgttcggcagtacgtactgcatgaagatttgcttcgccgtcagctcctgttccgctttttcgttatagtcgtccggataatcatttttgtactcttcgatcggcggcaagccacaggattgcggggtatcgcgcatcatcgcaaaggcgaataatgccaccagaatggcgcagaaagcaggcatatagagcgccgcatgccagtcattgaaccaggccatccccagcaggaacagcagcggcggaataccaccaccgacgttgtgcgcacagttccacactgacacaatgccgccacgttctttctgcgaccaccagtgcaccatagtacgaccacacggcggccaccccatcccctggaaccaaccgcagaggaacaacagtacaaacatcaccgcaatgctcgacgtcgcccatggcacaaagcccataaacaacatcactgccgccgccagaatcaaacctgcgggcaggaaaacgcgcggattcgagcgatccgataccgaacccatgatgaatttcgaaaatccataagcaatcgagatccccgaaagggcaaaacctaaatcaccgcgtgagaatccctgctcaaccagataaggcatagcaagcgcaaagttcttacgaaccaaatagtaagccgcatagccaaagaatatccccaggaaaatttgccagcgcaatcgacgataagtcggatcgatctccgcggcaggtaagcgcgctttgtgtggcgctggtttaaaaatactcaacattgatagcctccgtggcccgtggtcttatttatgattaacagcctgattcagtgagagaacctgccgtttcttgagttgccgcgatgttaagaaaacattcataaattaaatgtgaattgccgcacacattattaaataagatttacaaaatgttcaaaatgacgcatgaaatcacgtttcactttcgaattatgagcgaatatgcgcgaaatcaaacaattcatgtttttactatggctaaatggtaaaaaacgaacttcagagggataacaatgaaaactcgcgactcgcaatcaagtgacgtgattatcattggcggcggcgcaacgggagccgggattgcccgcgactgtgccctgcgcgggctgcgcgtgattttggttgagcgccacgacatcgcaaccggtgccaccgggcgtaaccacggcctgctgcacagcggtgcgcgctatgcggtaaccgatgcggaatcggcccgcgaatgcattagtgaaaaccagatcctgaaacgcattgcacgtcactgcgttgaaccaaccaacggcctgtttatcaccctgccggaagatgacctctccttccaggccacttttattcgcgcctgcgaagaagcagggatcagcgcagaagctatagacccgcagcaagcgcgcattatcgaacctgccgttaacccggcactgattggcgcggtgaaagttccggatggcaccgttgatccatttcgtctgaccgcagcaaacatgctggatgccaaagaacacggtgccgttatccttaccgctcatgaagtcacggggctgattcgtgaaggcgcgacggtgtgcggtgttcgtgtacgtaaccatctcaccggcgaaactcaggcccttcatgcacctgtcgtggttaatgccgctgggatctgggggcaacacattgccgaatatgccgatctgcgcattcgcatgttcccggcgaaaggatcgctgctgatcatggatcaccgcattaaccagcatgtgatcaaccgctgccgtaaaccttccgacgccgatattctggtgcctggcgataccatttcgctgattggtaccacctctttacgtattgattacaacgagattgacgataatcgagtgacggcagaagaggttgatattctgctgcgtgaaggggaaaaactggcccccgtgatggcgaaaacgcgcattttgcgggcctattctggcgtgcgcccgctggttgccagcgatgacgacccgagcggacgtaacgtcagccgtggcatcgtgctgctcgaccatgctgaacgcgatggtctggacggatttatcaccatcaccggtggcaaactgatgacctatcggctgatggctgaatgggctaccgacgcggtatgccgcaaactgggcaacacgcgcccctgtacgactgccgatctggcactgcctggttcacaagaacccgctgaagttaccttgcgtaaagtcatctccctgcctgccccgctgcgcggttctgcggtttatcgtcatggcgatcgcacgcctgcctggctgagcgaaggccgtctgcaccgtagcctggtatgtgagtgcgaagcggtaactgcgggtgaagtgcagtacgcggtagaaaatttaaacgttaatagcctgctggatttacgccgtcgtacccgtgtggggatgggcacctgccagggcgaactctgcgcctgccgcgctgccggactgctgcaacgttttaacgtcacgacgtccgcgcaatctatcgagcaactttccaccttccttaacgaacgctggaaaggcgtgcaacccatcgcctggggagatgcactgcgcgaaagcgaatttacccgctgggtttatcagggattgtgtggtctggagaaggagcagaaagatgcgctttgatactgtcattatgggcggcggcctcgccggattactctgtggcctgcaactgcaaaaacacggcctgcgctgtgccattgtcactcgtggtcaaagcgcactgcatttctcatccggatcgctggatttgctgagccatctgccagatggtcaaccggtgacagacattcacagtggactggaatctttgcgtcagcaggcaccagcccatccttactcccttctcgagccacaacgcgtgctcgatctcgcttgccaggcgcaggcattaatcgctgaaagcggtgcgcaattgcagggcagcgtagaacttgctcaccagcgggttacgccgctcggcactctgcgctctacctggctaagttcgccagaagtccccgtctggccgctgcccgcgaagaaaatatgtgtagtgggaattagcggcctgatggattttcaggcgcaccttgcggcagcttcgttgcgtgaactcggccttgccgttgaaaccgcagaaatagagctgccggaactggatgtgctgcgcaataacgccaccgaatttcgcgcggtgaatatcgcccgtttccttgataatgaagaaaactggccgctgttacttgatgcgcttattcctgtcgccaatacctgcgaaatgatcctgatgcccgcctgcttcggtctggccgatgacaaactgtggcgttggttgaatgaaaaactaccttgttcactgatgcttttgccaacgctgccgccttccgtgctgggcattcgtctgcaaaaccagttacagcgccagtttgtgcgccagggtggcgtgtggatgccgggcgatgaagtgaaaaaagtgacctgtaaaaatggcgtagtgaacgaaatctggacccgcaatcacgccgatattccgctacgtccacgtttcgcggttctcgccagcggcagtttctttagtggcggactggtagcggaacgtaacggcattcgagagccgattctcggccttgatgtgctacaaaccgccacgcggggtgaatggtataagggagatttttttgcgccgcaaccgtggcagcagttcggtgtaaccactgatgagacgctacgcccgtcacaggcagggcaaaccattgaaaacctgtttgccatcggttcggtgctgggcggatttgatcccatcgcccagggatgcggcggcggtgtttgtgccgtcagtgctttacatgccgctcaacagattgcccaacgcgcaggaggccaacaatgaatgacaccagcttcgaaaactgcattaagtgcaccgtctgcaccaccgcctgcccggtgagccgggtgaatcccggttatccagggccaaaacaagccgggccggatggcgagcgtctgcgtttgaaagatggcgcactgtatgacgaggcgctgaaatattgcatcaactgcaaacgttgtgaagtcgcctgcccgtccgatgtgaagattggcgatattatccagcgcgcgcgggcgaaatatgacaccacgcgcccgtcgctgcgtaattttgtgttgagtcataccgacctgatgggtagcgtttccacgccgttcgcaccaatcgtcaacaccgctacctcgctgaaaccggtgcggcagctgcttgatgcggcgttaaaaatcgatcatcgccgcacgctaccgaaatactccttcggcacgttccgtcgctggtatcgcagcgtggcggctcagcaagcacaatataaagaccaggtcgctttctttcacggctgcttcgttaactacaaccatccgcagttaggtaaagatttaattaaagtgctcaacgcaatgggtaccggtgtacaactgctcagcaaagaaaaatgctgcggcgtaccgctaatcgccaacggctttaccgataaagcacgcaaacaggcaattacgaatgtagagtcgatccgcgaagctgtgggagtaaaaggcattccggtgattgccacctcctcaacctgtacatttgccctgcgcgacgaatacccggaagtgctgaatgtcgacaacaaaggcttgcgcgatcatatcgaactggcaacccgctggctgtggcgcaagctggacgaaggcaaaacgttaccgctgaaaccgctgccgctgaaagtggtttatcacactccgtgccatatggaaaaaatgggctggacgctctacaccctggagctgttgcgtaacatcccggggcttgagttaacggtgctggattcccagtgctgcggtattgcgggtacttacggtttcaaaaaagagaactaccccacctcacaagccatcggcgcaccactgttccgccagatagaagaaagcggcgcagatctggtggtcaccgactgcgaaacctgtaaatggcagattgagatgtccacaagtcttcgctgcgaacatccgattacgctactggcccaggcgctggcttaaactcctttctgatgcccggtaagcatgtggttaccgggcatttttgcgtacacgattccgtgcccaatgtatgcgttgcaacgcagtgaaaattcctctgaaaacgtctcgcaaaggctgaaactggcagatgtcaaaggcctgggataaccgtaatgtcgcgtcatcataaatatcaggtgacggacaaccatgaccgaatcaacaacctcctccccgcatgatgcggtatttaaaacctttatgttcacacccgaaaccgcacgggattttctcgaaatacatttaccagaaccactgcgcaagctttgcaacctgcaaaccttacgcctggaacccactagttttattgaaaaaagtttacgcgcttactactcggatgttttgtggtccgtggaaaccagcgacggtgacggctatatctactgcgtgattgaacatcaaagctctgcagaaaagaatatggcttttcggctaatgcgctatgccactgccgccatgcagcgtcaccaggacaaaggctatgacagagtcccgctggtggtgccgttgctgttttatcatggcgaaacctcgccttacccgtactcactcaactggctggatgagtttgacgatccgcaacttgcccggcagttgtacaccgaagcttttctgttggtggatatcaccatcgtacctgacgatgagatcatgcaacatcggcgtatagctctgctggaactgattcaaaagcatattcgcgaccgcgatttaatcggcatggtcgacaggatcaccacgcttttggttagaggcttcactaatgacagccagctacaaacactgtttaattatctgctgcaatgcggcgatacctcccgtttcacccgttttattgaggagattgccgaacgttcaccactacaaaaggagagattaatgactattgctgaacggctacggcaggaagggcatcaaattggctggcaggaaggtatgcatgaacaagccattaaaattgctttgcgcatgctggagcagggctttgaacgtgagattgtgctggcgacaacccaactcactgatgctgatattccgaactgtcattaaaaggagagattaatgactattgctgaacggctgcggcaggaaggacatcaaattggctggcaggaaggtaaattagaaggtttgcatgaacaagccattaaaattgctttgcgcatgctggaacagggctttgatcgtgaccaggtgctcgcggccacccagctaagcgaagccgatctggcagcgaataaccactaattaacacaggcccacagccgatccccatgggcctttgatatcaataactaccttttatgcgtggcccatttttgcctgatttaaacatcgccagtcgttgatccagggcatcgctgtagagcatcgtgtcaacgccaacagcgacaaagttcgctccccacgccaggcattgctgcgccatatcaggagccacagccagaaaaccagccgctttacccgcagcacggatccgccgaatactggtttcaataattcgctgcacttccgggtgcccggcgttatccgggtagcccaacgacgcagaaagatccgcaggtccaataaacacgccatcaatcccttcgacgtcgaggatttcgtccaggttatccagtgccgttttactttccacctgcaccaacagacaaagcgaatcgttaacttgcgccatgtaattctcaatgcgtccccagcgcgcagcccgtgccacactggccccgacaccacgctcaccgtagggaggatagcgcgtggcagacaccacctgacgtgcctgttcggcagtatcgaccatcgggatcagtagagtttgcgcgccaatatccaggacttgtttaatcagcggtttactgccttccaccggacggatcacgggttggctggcatagggcgctaccgcctgtagctgatgataaagatcctgaatggtgtttggcgcgtgctccccgtcaatcagcaaccagtcataaccagaagtggcggcaatttctgccatataggcagtcgttgagcttaaccacagaccaatttgcacttcgcccttgcgtaaacgttctttaaagggattgcttaataatgcgttcatcgtgttccttaacctatttaatgatgtgccacgtcggtctgcgcaacagtgcgatttacacgcagagtgaaaataatcagcgaaccgatgaccgccaccgctgccagcgtcagtaatcccgccgcatcgctggcaaataacgtttctgctttcacgcgcaggatcggggcaataaacccgcccactgcaccaaacaggtttacaaaaccaattcccgcagccagcgccgtaccggaaagcagttgtgtcggcatcgtccagaacactggctgcacggcaataaacccgatagctgcaacacacagcgctacgatcgccattactggagaaagcagcccggacagaccaataccaatgcccgccgccagtaatgtcagcgctgcgacattacgccgttcgccggttttatcggaatagcgcggaataagccaggtcccaaacaaggccgcaacccacggaatggcggtgaccaccgacgctgtaaagcccacttttgttcccagcaatgccgcaacctgggtcggcaggaagaaaattaatccgtaaaccgccacctgaatggtcaggtagataatcgctagttgccagactcggccattacgcagcgcatcgctcagccgagaagtcactttctgttgttcttcacttgccagttgattgataagcaacgttttttcttgtttactcagaaaacgtgcctgctccggtgtgtcatcaagccaaaagaatgtgaataccccagcaccgactgccaacaatccttcaatcacaaacatccagaaccagccgggatgccccataaatccatgcatctccaacagcgcgccggaaagcggtgatcccagtgttaacgccagcggtgcgcccatatagaacagccccataatgctggcgcgattacgctgcggaaaccattgcgaggtgagataaatcataccagggaaaaatccggcctccgcagcacgaagcagagtgcgaactatcagaaatttcgcttcagtatcggcccatgccatggctgccgaaagaaatccccacagcagtgttgtcgtaccaatccaggttctggcccccagtttgcgcatcaaaagattcgccggaacacccagaaacgcatataccacaaagaaaatgcctgctcccagcgcataagcttcattactcaacccggtatcaatctggtaggtctgtttggcaaaaccgatattcgaacggtcgagaaacgccagcacatacagcgccaacataaacggaattaaacgcacacggtttttcttcaccacggcgtcaagcaaagcggtgctcataaaaagctccttagaatatgtgggcgttaccgttgtcacagcaacgcccggagtgattagtggctgtaggggcgtttcaaattgcagtcacgattgagttcgacgccaaaaccgggtttatcaagcactgatttatgaatacgaccattcaccggaaccggctcattgagcagaatcgggtcaaactgcggacgcatcgttgaacaatccgggctggtcatcaggaattcgctgaatggcgtattggtgaaggtgatcaccgcatggtgagagtaaacagacgaaccgtgcggcaccaccagttgccccctggatttggcgattgcggcaatttccaccagcgtggttaaaccaccgcaccagccaacatccggctgcataatgtcgataccggtttctgaaagcgtacgaaaagattgcagtgtgccgtggtgctcaccgctggtgaccatcattccgactggcgcgttgcgtttcagttcgcgataactttcatactgctgtggcggcaggcactcttcgatccatttcaggttatagggcgcgcaagcgtgggccagtttggtcgcatagttcacgtcctgactcatccagcagtcgagcattaaccagaaatcctcaccgcatttttcacgcatatccgcgaccatagcggcatctttgcggatccccgcatcgccatcatgtggcccccagtgcgtcggcattttgccaccgataaagcccatctcttttgccagatccggacgcgcacctgtggcgtagaactgaatctcatcacgaacagcgccgcctaaaagtttataaaccggaagcccgaccactttgccgaacagatcccacagagccagatcgacacaagaaatcgtattcatcaccaggccaccagagccggagtaatacagggtggcactgagcatttgatcgtggatcagtttgatatcactgacacatttaccctcaatgaaacggttaagatgtttttcgacaataaaacagcccatttcaccggctgtcgaaacggcgaatccggtctggccgttttctgcttcgacttcaacaaccaacgtgccaagaacgttaatgccaaatgactggcgtgactgctcgtaatcgcggtatttactcatcggggtggcaatatgatcgtctatccagtgattcgccccctggtcgtgataatcaccgccgccagcgcctttttctgctgtcgcaccgccagtaaaccaggcgcgaacctgtttaatttttggtagggtcatgatgttctccattgttatgaggcttgtaagtcaaagggacttttccatcccaacagacgtgaaatatccctggcgcaggcaatggccttgcccgccagataatcacggtattcttcattgatttgtaagcgggtaccgaccaccgagatcgcagcggtaagctcgttattggcgttaaacaccggcgcagcgacacaacggacatcggcgtaatcttcgccgttgtcatagctccagccctgacggcgaatacgcgccagttcttcgtgaagttgctgtggatgagtaatcgttgtgggtgtcgcctgctcccagaccagcccttcgataatactttgctgtaccgctgcaggttgccaggcaagcaggcatttacctattccggagcgataaagcgaaaggctttttccttcatgggaacgcacgctgatagtggctgatgactccactttcaaaatgtaataagcgctgccgttatcaataatccccaggtgacataacagcccggtggtatccatcagttgcgtcaaacgcggtcgagccagttcccggagatccatcttgcttaacgcatgaccggaaagctccaccagcctggtccacaaacaaaaattttcctggtgatcaaggctaagaaaacgctgacgcctgagttcattaagcagcaaataggccgtgcttttagggattcccaatgtgtcaatgatcgtcgcagcactacaggggccaatgcgggcaatcaaattgagaatatcaatagcccgtgtcagggcgggaactttgcttgattccaacatactggactccagtcttagatactggaatcagtctcgttgctcagggggagtaaaattgtgaagcgcatcaaatcccgctcctcgtccagcagactggagaaattacgcacaaatttgtgaatcagcgcacggattttttcttattgagtacaacaggttggacaaattttgccggagggggaatgtgccggtgcagtaaaccggcacagagtggcggaatcagacagataaggtcatggactcaacaacctcaatccagccatgctcactggcgatatcctggccgtttaaccaacggcgcagcatattcagtgccatcattgcgcacacttcctgacggatagccaggctgtagcgcgtagtgctgaaacgcacacgcagagcgaaagtgccgtctggcgtggctagcgcaaagttgagatgctcgttctcgaaacccgaaacagccagtgccagcccggcaaaatggttggcccgccgttctgtaatccagtgcgcagtttgcgccagggtttcctcctgtgaaggaaccacttcacacgccagcaatggagcacctgcgcgagaaagttgcaaagccaataaaccaccggtgaattgctcgctcaacgtcaggctgaactggcggttttgcaattcgcgactgatctgcgcgggcagtccttcagtgccttcgaaaatcacgctctgtccggcaacacgtttaacatccagccacagtttttccatcgcctgttgctcgcttgccggtccggtgagtttcagttcgatgataggcattgaggagcgatagcccattgttacgcccggcggcagttgtagagtgtccaggctttgtgccagatcgctttccgaacgaccaaaagtagtcaaacgcagacaaaccggcggctgcggtaaagaaaaacgctcgcgcaggcgcggcaggatttcgtgctcgaccatcaccttaaattctgacggtacgccgggagtaaagaacatcaggcaacgattaagctgcacggcaaaaccacaggcggtgcctaccgggttattgataaattcagcactggcaggcagctccgcttgtttacggttgctcggtgccattactcgtccacgttcgtggaaatagcgttccatctctttgagccaggcttcatgcagcaccaggccttcaccttttgctgtcgcagcggcgagtgcgcttaaatcatcgctggtcggtcccagcccgccgttaacgatcagcacatcggcgtgctgactacgttcgcgaagaatggtgactaagtcatcaaggttatcccccaccgtattgcggcgagataatggcaacccctgatgaaagaaaaaatcggccagccaggcagcgttagtgtcaacgatttgcccgtgtaacacttcatccccggtggataacatttccacttttaacatggttatctcctgcttttgttatcgaatcactataacgcaaagggagataaggcgtagtaagaaactgaatggcgcgacagaatgccgcgccggaagggatcagaaactggcgttaaccccaacatacgggccgtcagccacggcgttgtcgcggttaccgtctttacccgacagattcaggtagcgataacccgcctcaatactgactggacgcataatggtgtaacgcgcgccagcattcgcttcttcataactttgaataccgctggagagcgaatccggagagtagtaatactcgccaaacaaacggaagctgttgccaattttccactgcaaaccacctcctaccgctgcggcataaccttcatcgccgtaattcgggttggtgtaaacgccttttccgccaacggtcgccattaacggcccgagaggcagattcaaccccagccccacgccagcgacatcaccgtcgtcgtcgttatgtgtccagttaccgcttaacgccaggcccgtcgtttcagtcccaaaaccgacaccaatattggtgtattctttacccgcctgaccgctgatgctcattgcattgaccgatgcagaaaccaacagcattccggccagacctgctagcgcaatttttttcattatcccctttcccacaagcaattaatcaaaattcccaaagctgcgggattgtactgcctggcacagaggattcaatgagcgaaaaaaaggatctagtcacttattgtaactaaatacttcttaaataattaaatgccgaaaaaataaacacactttatcgatacacacaaaaataataataagtacagttatcatcgcaaaagagattactgtcactttcacatatttgtgagttaccgtattctcatggtttctttttatttataaggaatatccctgtgcgacaacggactattgtatgccctttgattcaaaatgatggtgcttatttgctgtgtaaaatggccgacgatcgcggcgttttccccggtcaatgggcgatttcgggtggcggcgtggagcctggcgaacgaattgaagaggcactacgccgcgaaattcgcgaagaactgggagaacagctgcttttgacagaaatcacgccgtggaccttcagcgatgatattcgcaccaagacgtatgcagatggtcgcaaggaagagatttatatgatttacctgatttttgactgcgtttctgccaaccgagaagtgaaaataaacgaagagtttcaggactacgcgtgggtaaaacctgaagatctggtgcattatgatttgaatgtcgccacccgaaaaacgttacgtttgaaaggtcttctgtaacaatgatgacagccattactggctgtcagattgaaaatttagtggttaacgaattccccatccagataaactttgcctttttccacatgcatgactaaaccatccagataatcaggtttaaatgtcgcgtcacgcttatctttagcaatatatgtcaggcaatgattatgggtgaaaataacgatatttttatcaggcgctttgctttgtaagtccttaattgcactataaatctcattaccgcactgaagaagtcgtttatctaccgtcaattttttacccgctgaaaaccaggtagccgactgaatggtccggacggtattactggaataaagatcgaaatcagggatatcagcactaaaagcgttgcccagttcacgggcatcctgggtacctttaaccgtaatacctgttttatctgacaagcattgattggttgaacggtcgcaacgttcagcatgacgaaacaaaacgacaaccgggtgctgctgtgccagtctggccagtgttttattgtcgatacgtggcaaaccattgctactccaggcggcatgagtacccagtccggcaattgcagcgagcgccagtaaaatgatgatatatttttttgacttcaacgaagagcggcaaaaagctaacacgtaaactccacctatagacaagcgcaaccagacaattaccgtgaaattgagctacatttctggcgataattcgcagttggtgtaatattaaaaatcctacgatgtcggcaaaatgcctcaaaattttgccaaatgcaaagcctaaataagaaaaaatataaaaatttcaatatttacgtctaatattagtttcttaaggttaagttaatattctatccttaaaatttcgctccaaatggcaaaatatacacaacactctttatagcaaatataagtggacaggtattcaatggcggaaggaaaagcaatgtcagaatttttgcctttttcgcgaccagcaatgggcgtggaggaactcgctgcagttaaagaggttctcgaatccggttggatcacaaccggtccgaagaatcaggcgcttgagcaagctttttgccagttgacgggaaatcagcatgccatcgcggtcagttcagccaccgccggaatgcatatcacgctaatggcgttgaaaattggcaagggcgatgaagtgattacgccttccctgacctgggtttcaaccctcaatatgatttccttgttgggtgcaacgccggtaatggtggatgtcgaccgcgatacgctgatggtcacgcctgaagctatcgagtcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttctttgccgctgttcccggatatgactaccgccgatgccgaccatgtcatcacagcccttcagcaactcgcaggacaataagccatgtttgaaatccaccctgttaagaaagtctcggtggttattcccgtttataacgagcaggaaagcttaccggaattaatcaggcgcaccaccacagcctgtgaatcgttggggaaagagtatgagatcctgctgattgatgacggcagtagcgataattccgcgcatatgctggtcgaagcctcacaagcggagaacagccatattgtgtctattttgcttaaccgcaattacgggcaacattcagcgattatggcgggattcagtcacgttactggcgacttaattattacccttgatgccgatctccagaatccgccagaagaaatcccccgcctggtggcaaaagccgatgaaggttacgacgtggtagggactgtacgccagaaccgccaggacagctggtttcgtaaaaccgcttcgaagatgattaaccggcttattcagcgcaccactggcaaagcgatgggtgattacggttgtatgctgcgcgcctatcgccgtcatattgtcgatgcgatgttgcactgccatgaacgcagcacctttatcccgattctggcgaatatcttcgcccgccgtgccattgaaattccagtacatcatgccgagcgtgagtttggtgaatccaaatacagttttatgcgcctgattaatttgatgtacgacctggtgacctgccttaccacaacgccgctacgtatgctgagtctgctcggcagcattattgcgattggaggttttagcattgcggtgctgctggtgattttacgcctgaccttcggaccacaatgggcggcagaaggcgtctttatgctatttgccgtgctgtttacttttattggcgctcagtttatcggcatgggattactcggtgaatatatcggcaggatctacaccgatgtccgcgcccgcccccgctattttgttcagcaagttatccgtccatccagcaaggaaaatgaataatgaaaaccgtcgtttttgcctaccacgatatgggatgcctcggtattgaagccctgctggctgccggttacgaaattagcgccatttttacccatactgataatcccggtgaaaaagccttttatggttcggtggctcgtctggcggcggaaagaggcattccggtttatgcgccggataacgttaatcatccgctgtgggtggaacgcattgcccaactgtcgccagatgtgattttctctttttattatcgccatcttatttacgacgaaattttgcagctcgctcccgcaggtgcatttaatctgcatggttcgctgttaccaaaatatcgtggtcgcgcgccgctgaactgggtgctggtcaacggtgaaacggaaactggcgttacattgcaccgaatggtgaaacgtgccgatgccggggccattgtggcgcaactgcgcattgccattgcgccagacgatatcgctattacgctgcatcataaattgtgccatgccgcgcgccagctactggaacagacattacccgccattaaacacggtaatattctggaaatcgcccagcgcgaaaacgaagccacctgttttggtcgcagaacgccggatgacagtttccttgaatggcataaaccggcatccgtactgcacaacatggtacgtgccgttgccgatccgtggccgggtgccttcagctatgttggcaatcagaaattcaccgtctggtcgtcgcgtgttcatcctcatgccagcaaagcacagccggggagcgtgatttctgttgcgccactgctgattgcctgtggcgatggcgcgctggaaatcgtcaccggacaggcgggcgacggcattactatgcagggctcgcaattagcgcagacgctgggcctggtgcaaggttcacgcttgaatagccagcctgcctgcaccgcccgacgccgtacccgggtactcatcctcggggtgaatggctttattggcaaccatctgacagaacgcctgctgcgcgaagatcattatgaagtttacggtctggatattggcagcgatgcgataagccgttttctgaatcatccgcattttcactttgttgaaggcgatatcagtattcattccgaatggattgagtatcatgtcaaaaaatgtgatgtcgtcttgccgctggtggcgatagccacgccgattgaatatacccgcaacccgctgcgcgtatttgaactcgattttgaagagaatctgcgcattatccgctactgcgtgaagtaccgtaagcgaatcatcttcccgtcaacttcagaagtttatgggatgtgtagcgataaatacttcgatgaggaccattctaatttaatcgtcggcccggtgaataaaccacgctggatttattcggtatcaaaacaattacttgatcgggtgatctgggcctatggcgaaaaagagggtttacagttcaccctcttccgcccgtttaactggatgggaccacgactggataaccttaatgcagcgcgaattggcagctcccgcgctattacgcaactcattctcaatctggtagaaggttcaccgattaagctgattgatggcggaaaacaaaaacgctgctttactgatattcgcgatggtatcgaggcgttataccgcattatcgaaaatgcgggaaatcgctgcgacggtgaaattatcaacattggcaatcctgagaacgaagcgagcattgaggaactgggcgagatgctgctggcgagcttcgaaaaacatccgctgcgccatcatttcccaccgtttgcgggctttcgcgttgtcgaaagtagcagctactacggcaaaggatatcaggacgtagagcatcgtaaaccgagcatccgcaatgcccaccgctgcctggactgggagccgaaaattgatatgcaggaaaccatcgacgaaacgctggatttcttcctgcgcaccgttgatcttacggataaaccatcatgaccaaagtaggcttacgcattgatgtcgatacctttcgtggcacccgtgaaggcgtgccgcgtctgctggaaatcttgagtaagcataatattcaggccagcatttttttcagcgtcggcccggacaatatgggccgccatctctggcgactggtgaagccacagtttttgtggaagatgctgcgctcaaacgcggcatcgctttatggctgggatattttactggcaggtacggcctggccaggtaaagagattggtcatgccaatgccgatatcattcgtgaagcggctaaacatcacgaagtcggcctgcacgcctgggatcaccatgcctggcaagcccgtagcggtaactgggatcggcaaacaatgatcgacgatattgcacgcggtcttcgcactctggaagagattatcggtcaaccggtaacctgttctgccgctgcgggctggcgtgccgaccagaaggtgatcgaagcaaaagaagcgttccatttgcgctacaacagcgattgtcgtggggccatgccgttccgtccattgctcgaatcaggaaaccctggcactgcgcaaattccggtgaccttacccacctgggatgaagtgattggtcgggatgtgaaagcagaagattttaacggttggttactcaaccgcatcctgcgagataaaggcacgccggtttataccattcatgcagaagttgaaggctgcgcttatcagcataattttgtggatctcctcaaacgcgcagctcaggaaggcgtgacattttgccctttaagcgaactgttatcagagacgttgccgctcggacaagttgttcgcggaaatattgccggacgtgaaggctggctgggttgccaacaaattgcgggtagtcgctgatgaaatcggtacgttaccttatcggcctcttcgcgtttattgcctgctattacctgttaccgatcagcacgcgtctgctctggcaacccgatgaaacgcgttatgcggaaatcagtcgagaaatgctggcatccggcgactggattgtgccccatctgttagggctacgttatttcgaaaaacccattgccggatactggattaacagcattgggcaatggctatttggcgcgaataactttggtgtgcgggcaggcgttatctttgcgaccctgttaactgccgcgctggtgacctggtttactctgcgcttatggcgcgataaacgtctggctctactcgccacagtaatttatctctcattgtttattgtctatgccatcggcacttatgccgtgctcgatccgtttattgcattctggctggtggcgggaatgtgcagcttctggctggcaatgcaggcacagacgtggaaaggcaaaagcgcaggatttttactgctgggaatcacctgcggcatgggggtgatgaccaaaggttttctcgcccttgccgtgccggtattaagcgtgctgccatgggtagcgacgcaaaaacgctggaaagatctctttatttacggctggctggcggttatcagttgcgtactgacggttctcccttggggactggcgatagcgcagcgggagcctaacttctggcactattttttctgggttgagcatattcaacgctttgcactggatgatgcccaacatagagctccgttctggtactacgtgccggtcatcattgccggtagcctgccgtggctgggattactccccggtgcactgtacacaggctggaaaaaccgcaagcattccgcaaccgtctatttgttgagctggacgataatgccgctgctgtttttctccgtcgctaaaggtaaattgcccacctatattctttcctgctttgcatctctggcaatgctgatggcgcattacgctttgctggcagcaaaaaataatcctctggcgctgcggattaatggctggattaacatcgcttttggcgtcactggcattattgccacatttgtggtctccccgtggggaccaatgaacacgccggtgtggcaaaccttcgagagctataaagtcttttgtgcctggtcgattttttcgctatgggcatttttcggctggtacaccttaacaaacgtcgaaaagacctggccttttgccgcgctttgcccgctggggctggcgttgctggtaggattttcaattcctgacagagttatggaaggaaaacatccgcaattttttgtcgagatgacacaagaatcacttcagccaagccgctatattcttactgatagcgtcggtgttgccgcaggtctggcatggagcctgcaacgcgatgacatcatcatgtatcgccagacaggtgagttgaaatacggccttaattatccggatgcgaaagggagatttgtcagcggtgatgagttcgcaaactggcttaatcaacatcgtcaggaggggattattactctcgtgctttcggttgaccgcgatgaagatatcaacagtctcgccattccgcccgcagatgccatcgatcgtcaggagcgtctggtgctgattcagtatcgtcccaaatgatctggctaacattagtctttgccagcttgcttagcgttgccgggcagttgtgtcagaaacaggcaacctgctttgtggcgataaacaaacggcgcaaacatatcgtgctgtggctgggactggcgctggcttgtcttggtcttgccatggtgctctggctgctggtcttgcagaacgtaccggtaggcattgcttacccgatgttaagtctgaattttgtctgggtgacgctggctgcagtaaaactgtggcacgaaccggtatcgccgcgtcactggtgtggggtggcgttcattattggcggcattgtgatcctcgggagtacggtgtaatgggcctgatgtggggattattcagcgtcattattgcctcagttgcgcaattaagcctgggttttgcggcgagtcatctgccgccgatgacgcacttatgggattttatcgcggctctgttagcttttggcctggatgcccggatactgttactcgggctgctgggttatctgctttccgttttttgttggtataaaacgcttcataaacttgcgctaagcaaagcctatgccttgctcagtatgagttatgtgctggtatggattgcttcaatggtacttcccggctgggaagggactttttcgctgaaagcactactgggagtagcctgtattatgagcgggttgatgctgattttcctgcccacgacaaaacaacgttactgagttttccctgccactttacactgccgttcccactcatcggggctataactgcttgccgagaggactttcaccgtatgcagcttttcacgattaatacaataaagcgcattctgcaaaggcgagagtaaatcccccactttcacggcgaagtcactcttcacttcggcgatcatttttatcgcgccgccagcatcgcagagcataagtacatgtctgttatcttgtttattgcagcacgattttttgaccagccattccattgcattatcctgtttgctaagagttttcacatcaatttacagattaacagataaactctttatcaacggcaatggaatggcagaaatgagaagtgaaacggagggttaattattgctgacgttgcacccactcttttagcgcctgacgtgaaattttaataccgccgtttttcagctccggcggcagagttagccagcgcaccggttgttgaaaacgggccagcttatctttcacccattcactaagatcaacgctctcgtggtcatactccatcaccgccaccggtcgatgaccaaactccttgtcggcaacggggacgataaacacctgcaaaaccgcaggatgtgcagcaattacgcgctcgacttcttccggctgaataccctctccgccactgaagaatagattgtctaaacgtccgacaatggtcagcttgccattatgcatctcaccgcgatcgcgcgtagcgtaccagccttcgtcattaaccagtgaaaccagttgcccgttacgccagtaaccttctgccatactggcagcccgcagccacacttcattattaacgattttcacttcccgacccggcagcggcgaaccaacgtctgccaggccgtcggcttctttcgcacacaccgtggaggcaaactcggtcagaccatagccgcaaaagcaacgaatcccctgctcgcgcgcctgttccgtcaactcgaccgggatagccgcgccgccaagtaacaccgctttcagggaaacggaactacggttaaccagcaaacgccagagttgtgttggcaccagtgaagcgtgagtacagcctgccagcatttgctccaatggctgtttatcacgtaccgtcatccgcgcaccagcgtataaccagcgccacataattccctgaccggagacgtgaaacagcggtaaagagagcaaccaatcatcgtgatcgccaaacggaatcagcgataacacaccttgcgcactggcaagatgggcctgataagtatggacagcggctttcggcaaaccggtagaacccgaggtcaacgtcattgagcacagacgcgtcggctgccacgtagcggcatgtgcgccttcaaccagctgaatgtgcagcgacgttaatgccggaaacgtgttttccccatccggcaccagagcaaattgcagcgtcagattgggcagcaattcttcaagcaacggttgcggcagctgagggttcacgggcaacacccgcgccccgcattgcagtaacgccagccaggcgagcagcgtttgcggcgtattccacgcccgcaacatcacgccgctgccctcaaccaccccctgcaccgcaaatccggaggctaattcatcgacgcgagcacaaagctcgcgccagttgagttgctcgtcattaagacgtaaggcgatggtttctccccgcacttgccgccagtgacgccacggccagtcagagaagatcataacaaccgctccagtgcatcaacttccacgacaggcagcgtgctacccggccagcgacgtacctgctgcgcctgcatcagatccagcgtgtccagccctggaatggtgtccggcgttaaccaggcggcaatccgcgccagttgcgttaagcctaagctcgattcaatggaagaactgatcaccgccgtcagccccagcgcgtgcgccgcctgtacctgctcgcgtactttttccagactgcccgtgagcgtgggtttgataactaccgcgcgcacgccctcttcagccacaaaggcaaaatccggctcgcgcaggctttcatcccaggcaatggcaatgccggtttcacgggcaaacgctcgcgaatcatcgcgggttttgcacggctcttcgagaaacgcgatgcggtcgcgataatccgggttaacgtatttggcaaactgctgacctttcagcggtgtccaggcgcgatttgcgtcaagacgcaaatgcagatccggaattgcctccagcaacagattcaccaccatgccgtcgcgcaccgcttcgtacaatcccactttgaccttcgccactttctcgcctggcatatctgcaagtttgaggatcagatcgtccggatcgccattacacagcggtgccgcacggtagttggctgcttgcggcaacgtatctgtcagttctgccaatgcacagcttacgccaaaggccacggaaggcatctgcggtagctcgcaatcgcctgccagccagttatttacccaggcaagcagcacactttgcgcctcttcccaggtttcctgactgaagcccggcagtggggagatctccccccacccttcgcgctcgccttcacgcaggcaaacatacagcccgtcgcgggtttttaaccgcctgtcgcgcagaaccacccccgcgtccatggggatctgccagcggtatacctgcgcgctacgcattacggattccgtttgaatttgctgaagtcaggctgacgtttctggttgaaggcgttgcgaccttcctgaccttcttccgtcatgtagaacagcatggtggcgttgcccgccagctcctgcagccccgcctgcccgtcacagtcggcgttcagtgcagctttcaggcagcgcagcgccatcgggctgttttgcagcatttcgcggcaccaacggacggtttctttttccagatccgccagcggtaccacggtgttcacaaggcccatatccagcgcctgttttgcgtcgtactgacggcacaggaaccagatttcacgcgcttttttctgcccgacgatgcgagccatgtaggaagcgccccagccgccgtcgaaggaaccgactttcgggccagtctgaccgaagatggcattatctgccgcgatagtcaggtcgcacatcatgtgcagaacgtgaccgccgccgatggagtagccagccaccatcgcgacaaccggtttcggacaggtacggatctgacgctggaagtccagcacattcaggtgatgtacgccggaatcatctttatagccgccgtaatcaccacgcactttctggtcaccaccggagcagaacgctttatcgcctgcaccagtcagaatgatcacgccgatgttgtcgtcataacgcgcatctgccagcgcctggatcatctcttttaccgtcagaggacggaaggcattgcgcacctgcggacgattaatggtgatttttgcgataccgtcggtggatttttcataacgaatgtcctcgaaaccttcggagcagtcgtgccattcaaccggtgcgtaaagcattgcttcatcaggataaatcatattgtgtcctttagtcagaaacgcaagatctgcgccagacttgcgattacgccagcgggattttcccgatgcgcgttatgtccggcgcgaggaatgacatggcagtcggcagccagttccgccgccagggcgcggaatttgctgtcacgttcaccacataaataataaaacgcaaatgtgcgggcgctaaggttagcacgtaaatcaggctggacggcgagagaagtcgcctccagcatggcggcaagcgttgcgccattattgttgctgcgcagcgccaccagctcccggcgttgatcgtcattgagtgaggcaaaaacaggctgttgataccagtcggcaaataccgccgttaacggttctgtgagaaaacgctgcacccattggcgatcggaacgctgacgttccgcacgttgttcagcattttgcagccccggatgcccgccttcgacaataaccccacaaagccccgccagcccctggcaagccgccatcatcgccacccgtccaccaagcgagtaccccaccagccagaagtcaaggatgttgtaactaaccaaggttttacgcagtaagtcggtgacatcatcaaatccatcgacgctaatcgccgccgaaccaccgtgacctgggagatcaacatacaaccgtgagtagtcggcaaacgcctcgcccacttcttgccattcgtggcaatcgccggaaaaaccgtgcaaaaacaccagccagggtaaacctggttttccgtgttttgcctgcgcgtgcaggatcataaatggcttacctgcgccagaagttgctggagcgtttgcgcaccatcggtgtcgttaaccaccatttcaatcaccgtggtggttggcgtgcgccaggcgtcggcaaatgccgtttcaagttcctgccagttttgcggacgatgatatttcagctcgaacatcgcggcggcgtgctcaaaatggacgttttgcggcatcagatagaaacgctcacgctcgctttgcggcgttggcaacagcgagaaaatttgcccgccgttgttgttcaccacaattaataccagcggcgcagaaacctgacgcaataacgccagcgcgttgagatcgtaaagtgcggagagatcgcccacaatcgccagcgtcggtttgccgcttgcccgctgaacgccggcggcggtcgaaagcagcccgtcgataccgctggccccacggttgctgtacaccgggtaacctgccggaagttgcgaaagcgcatcaatcagacgtaccaccaggctgttaccaacaaacaattgcccctgttcaggcagatagtcgcagatgcgatgcgccagttgcgcttcgccaaacgcatcacggcgggcaataaccgcctgcattgcctgttccgccaggcgcgggatttcaacgcaccagggctggcgtttttctgccggatgcagctccagccagtcggcaatattggcaattaagcgacgtccgcgatggtgtgccggatcaagtcgcccttcaatgtcatcaacaatccagtactcttctggttcacagcttgcctgccattgcaggagccgtttccccgtcaggctgcttcccagttgcaccacaatttgcgcctgctgcagctcgctggtcgctttggcattgcctaaccaaagatcggcacacggcagcggctgcccggtttgtgacagcacatcgccaatcagcggccagccaagagtttgcgcccacagggcaacttttttgccctcttccgcactcatgcgcccggcaaccaccacgccgcgcttttgtcgccagaagaaccagtcgcgctgtttttcactttccagacgaggcgcttcacgcagccacggtttgtcgtcctgccaccagtcacccagacgctgttgccagctaagcccggtatcgtccatttcgccatacagcggttcagcaaacgggcagttgatatggactccccccgcatgaagcgtaccgagagcgtggtcgatggtagaaaccagccaacgtgcggggatatcctgggtcgggcgcggcaatgaaatactgtgcgtggggtgagaggcgaacattcccggctggcgaattgcctgattcgcgccgcagtcaattagctccggcgggcgatcggcggttaagagaatcagtttttctccggttaacccggcttcaatcagtgccggatagagatttgccaccgccgtgccggaggtcacaatcaccgccaccggctgcttgctgactttcgccagccccagcgccagatgccccaacccacgctcatcgaaatgggtgtggtgaatgaatgcggaattctccgccgccgctaacgttaacggtgtagaacgcgagcctggggcgatacagatgtgtctgacgccgtgacgcgttaatgcttccagaatgaccgccgcccagcgtcggttaaatgcgcttactgacatgagtttgtccggtatcaatattgcggctaagtataaggagctacaaaaatagattattgatatgaatcggtaatgatgcgactcattactattccatttgtaataaagtacgcagccctgccgctttgttgtcgatttcctgccactcttgctcggggtcggaaccacggacaatgcccgcgccagcatataatcgcacgacattgccgctaatttttgctgagcgcagggaaacgcagaattcgctttgttgtaatgagagatagcccgcagaaccggcgtaccattctcgggtgaacggttcgtgacgggcgataaactgtcgcgccagatcgcgcggtaagccagcaactgctgccgttggctgcaactgatgtaaacagatcacatcatccgctttgttgagtgaagtccagatacagcggcgaagatgctgcactttacgcagacgcagtacctgcggcggtaaaacatccagcgtctgggtatcggcctgtaatcgttgacagatatcttccaccaccagcatgttctcgcgctggtttttatcatccgccatcagccactctcctaactgctgcgcctgcttatcatcaggattatttgctactgttcccgccagcgcttcagtacgcagcgctttgtcacgccgccgccataaccgttccggtgaagagccaagaaaagcattttcgccatcaaaggccatgtaaaaatggtagcaattcagattcagtcgacgactggcagccatcatcgccgccgcgttgaccggacttgcgaaatgcaggtcagttgcccgagcgagcaccactttgtcgagctcaccttcggcgatggttttcgttgccagttcgattaattgcgtccagcccgttttgtccggccagtgttgttctcgcgtggtggttaaatgtaacccaggcaagggcttgatactcaccagtgtggcgataaattcttttgcctgaatcgcatcgtgctgaagggagctttcgctgaatagcgtcagccgcagcgtggctttaccgccacagcgtcgccattccaggcggggtaaaagtaaattgccctgcgacgggtcaaaagcattcagcccccaaatgcgtaagtcggcgtgttccgggtgctggcgaagaaaacgttgtgcctggtccaacgacgtaaaacgggtaatcgcgcccaggacgacagcttcttcatcaccattacgttgttgccagtagaattgcgggtatgtttgctgactggccagccagctcaaggcatcaaaagcgtctttgagagggaaaggaatatcgataacccgaatgccgggtgtcgccggaatctcttgcgacaaatggcgcagtagattttccagcgccgtagtaagtgattgcacgcggacctctccctgttaaaagcctcacattatacggggtactacaaaaaaaatgcagtaccccggtgtagggaggttttaacggcgtgccagcaacagtcctagtaccagcccaacggccgcgcccacaccaattccttgccagggtttttcgtggacgtagtcatcagcacgataaactgcctgcttcgcccgatagtaataactgtctgaagcctggctaacccgttttttcacatcatccagcgctttttctgcacgcgctttcagctcaacatatttctgatcggcgggatcgccagaggagcggagcacctcttccagtgtttcactaagcagcgtcaggtcgtcatcgatacgtgtatcaccaaactgattagacattctcgttctccatttgcgtaaaacctgtcactaactatagacaagggttgttgattacgcctgaattacctcgcgtgccatcccaatgtgtgggataccatcttcttcatagacctccgtcacagggataaaaccgaaactctggtagaagttttgcagatgcgcctgcgccccgaggtaaacaggcttatcaggccagtgatgcgtacatgtttcgagtgttttactcatcagctgctgccccactttttcgccacgcaacgcttcactgacaatcacccgacctataacgaccggctcaagatcatcatcacttttcagaatcctcgcatacgccaccagttcatcatttttccaaccgagaatatggcgattatcccccgtcaaatcatcaccatcgatatcctgataagggcaattctgctcgacaacaaacaccgcgcaacgcagttgtaataaggcataaagctgggaaaccgataattcagagtgatgcagatcttgccattcaatcataatgctctccttttagatgtatgccttatactagccggaatattttttgaaacgtgatgaactcatggaattaatttttttaggtacttcagccggtgtgccaacccgcacgcgcaatgtcacggcaatattgcttaacctgcaacatccgacccagagcggactttggttgtttgactgcggtgaaggcacccagcatcagctactgcataccgcctttaaccctggaaaactggacaagatttttatcagtcaccttcatggcgatcatctttttggtttacccggcttgctgtgcagtcgttctatgtcaggcattatccaacccttaacgatttatggtccgcaaggtatccgtgaatttgtggaaaccgcgctgcggattagcggctcatggaccgattatccgctggaaattgtcgaaattggcgctggcgaaattctcgatgatggcctgcgcaaagtaaccgcttatccgctggaacacccactggaatgttatggctatcgtattgaagaacatgataaaccgggtgcattaaatgcccaggcattaaaagctgctggcgtgccgcctggcccactgtttcaggaattaaaagcgggcaaaacaatcacgctggaagatggaaggcagattaacggcgcagattacttagctgctccagtgccaggtaaagcgctcgctattttcggcgataccggcccctgcgatgccgcacttgacctggctaaaggtgtcgatgtcatggtgcacgaagcgacgctggatataaccatggaagccaaagccaatagtcgcggccatagctctacacgccaggctgcgacactagcccgtgaggctggagtcggcaagctaatcattacccacgtcagctcgcgctatgatgacaaaggttgtcagcacctgttacgtgaatgcaggtcaattttcccggcgactgaactggcgaatgatttcaccgtgtttaacgtttaactctgcttattattaaaaacagggcgaaacttgccctgttatcgcaacccgcgctacatatatccacccacacaggcatattgagcgatttttgatatttattcatctccttacgcactatattcagagcaataagttgcctcttttcatcttgattcagcacaacctttgcaactaaaaggagcccatgatggttacagttgtcagcaattattgtcaattatctcaaacgcaactcagtcagacatttgcagaaaaatttactgtgaccgaggaattactgcagtctttaaaaaaaacagcgttatccggagatgaagaaagcattgagttactgcataatattgcgttaggttatgataaatttgggaaagaagctgaagatattctttaccatattgttagaaccccaacaaatgagaccctatcgattatccgacttatcaaaaatgcttgtttaaaattatataatctggcacatatcgcaaccaactcccccctcaaatcacatgattcagatgatctcctgttcaaaaaactattctccccttcgaaattaatgacaattatcggtgatgaaattcctcttatatctgaaaaacagtcgctttcaaaggtgcttttaaatgatgagaataatgaactgagtgatggtacaaacttctgggataaaaatcgtcaattaaccacagatgaaatagcttgctatcttcagaagatcgccgctaatgcaaaaaatactcaagtcaattatcctactggtctctacgtcccctactccaccagaactcacctggaagacgctctcaatgaaaatattaagagcgatccatcatggccgaatgaagtccagttattccccataaatactggcggacactggatattagtttcgctacagaaaatagtaaataaaaaaaataataaactacaaataaaatgcgtcatattcaactcattgcgtgcactaggctatgataaagaaaattcacttaagcgtgtcattaatagttttaattctgaactcatgggagaaatgtcgaataataatataaaagttcatttaaatgaaccagagataatatttttacatgccgatcttcagcaatacttaagccaaagttgcggtgcatttgtgtgcatggcagcccaggaagtgattgaacaaagggaaagcaattctgacagcgccccctatacgttattaaaaaaccatgctgacagatttaaaaaatattcagcagaagagcagtacgaaattgattttcaacatcgactggcaaacagaaattgttatttagataaatatggcgatgcaaatatcaatcattattatagaaacttagaaataaaacactcacaacccaaaaatagagcatccggcaaaagagtgagttaacatcattgttaattaattcgaccagtcagcaaatatgctgactggtcgaacatagtttgctaaacagtcatcactgactgatgtcagtcacaccatccgccagttcaatcaggcgaataaattccgccctgtaaccctgtggatcttccccttttgcctgctgagcccactgtttgatctgctgccaggaggtattgttcaggtattcagaaccgcgtaacttttgcccatatgcagctactgctgcgcgaaaacgcatatcttcagagggcgcgtttattgttggccccagcgggaattcaactaactgactttcttttccctgcgggtatttccagcgaatttttaaccaggccagttctttcgttttgtccgatttcgctaatttgttatccggggcatagcgtaacttatcaattgatgctttttgcccgttcagcgttaattcgaataacaacgttatatgtttgcctgcgcctatatcccctgcatcaacgttgtcgttattaaaatgttccacccgaagttggcgcttttcataaccaatctgacggtattccgttacccacgcggggttaaactcaatttgcgctttgacatcttttgctacggtaatcaacatctgccgcatttcactattcaatactttctgcgcttcagagagggtatcaatgtagctgtagttgccgttaccaacatcggcaattcgcaccatcattgcctcgttgtaattgctattccccacgccaaacgtcgacagagtaacaccagactcccgctgttttttgaccattgattcaatcgattttggatcgtcaatgccaacgttaaagtcaccgtcagtggctaataaaatgcgattgatgccgcccttaataaaccccttcgtcgcctgctgataagccagttccagcccggcaccgccattggtactgccttcggcatccagcgaatcaattgcggcattaatttccgccttatgactcccggagatagaaggcaatgcaatacgggagtcgccagcgtaggtcacgatggcaatgttatcctgctcacgaagttctttgaccaataatttcaacgaagactggataagtggcaaacgttcatcagaaatcattgaaccagaagtgtcgataagaaagaccagattagaagctggtaactcttcacttttgcgatctttcgccaggatatcaactttcagcaatgttcgctgttcattccatggtgcaggtgccaattcgtagcgcatagcgaaaggtattggcttagaggccggaatagattgtttgtctttgatatcccaatcagacgggaaataattgactatctcctccacccgcacagcgtctggcggaggtaacagcccttgattgaggaaacgccttacattcgcataactgccagtgtcaacgtcaagactaaacgtcgccaacggattttgcgctacctgcttaaccggattatcatcgaactgctggtagcgagcggttcctggatttgcgatatgtgtagcttttgctttagccgctcttgcaaatgttggcgcttcctgcaatcgcccctgtaaagcctgtttgtctgaatattgttgcacttcttgctgggccaaggctttcgcggcggcggcgctttgctcagcctcttttattgcagcttgctgcgcggcaagcacttgctgctctgtgggagtactgggttgttgttgctgactttccttattctcaggttgcggcccacatcctgacaaaatcaaactactcataagcaacatgattatatttttatttcgcatataaaatccttttaaataaactcaggcaccagacataaaatatactctttgtataatcctgctaatcttaataaaatacaatatcgaaacccatagcaaataatgattcaacaacgcaacccattaataatttgcatatgaaaaaaataatctttgcttttattatattatttgtgtttttactccctatgattattttttaccaaccctgggtcaatgcattaccgtcaacgccccgacacgcaagtcctgagcaattagaaaaaacagttcgttatcttacacaaactgtgcatccacgtagtgccgacaatattgataatctgaataggtccgcagaatatataaaagaggtctttgtcagtagcggtgccagagttacctcgcaggacgtccccattacgggtggcccctacaaaaacattgttgctgattatggtcctgccgatggaccgctgattattattggtgcgcattatgactctgccagcagttatgaaaacgatcaattgacctatacgccgggcgcggatgataacgccagcggtgtggcaggattactcgaactggcacgtttgttacatcagcaagtaccgaaaacaggcgtgcagctggtcgcctatgcgtcggaagaaccgcccttctttcgtagcgatgaaatggggagcgcggtgcatgcagcttcgcttgagcgtccagtgaaattaatgatagcactggagatgattggctattacgactctgcgcctggaagccagaattacccttacccggcaatgtcctggctttatcccgatcggggagactttattgccgtggtcggcagaatacaggatatcaacgccgttcgtcaggtaaaagcggcattgttgtcatctcaggatttatctgtttattctatgaataccccagggtttattcccggtattgatttctctgaccacctgaattattggcaacacgatattcccgccataatgattactgacaccgctttttatcgtaataaacaataccacttgcccggtgataccgcagacagattgaattatcagaaaatggctcaggtagtggatggtgttataactttgttatacaacagtaaataataaaaatttctcgaggcgggtccagaaaaagcgacatgcacattttattttccctcatctgttttaagatgcgaaacatgaaattcaacggaggaaaaataaatgggaatgattggctattttgcagaaattgactcagaaaagattaaccaactgcttgagtctactgaaaaacctttgatggataatatacatgacacgctttcaggattacgccgactggatattgataaacgctgggattttttacactttgggctgacaggcacctctgcttttgatcccgcgaagaatgatccgctgagtcgtgccgtgcttggtgaacacagcctcgaagatggcatagatggcttccttggattgacctggaatcaggagttagccgcgacaatcgaccgactggaatcactggatcgaaatgaactgcgtaaacagttttccattaagcgactcaatgaaatggagatttatccgggagtgaccttttcagaagagttagaggggcaactctttgcctcgatcatgcttgatatggaaaagctgattagcgcgtatcgacgtatgctgcgacaagggaatcatgcgctgacggttattgttgggtgatatagcttgatgcctgggggagaaagacccattagttaagatttacgccaggatcatcttgaaaaaatctttaaccatggtccggtttttatccccttgtataaatattactaaatgcttgcttagtcgcattgttaaatgcaataccgtatattcggtatgtaacagcgatatcctctgtgctggcaacgatctgtcatgcttgatgaaaacggaattgaacctgtcattaccaggtagataaaaagcctgttcaattttgggattattttttataactcgtgtctgttatggcgacacgggaaaacatcaatattgtccttcacaaattgcagtaatatagaatcaacctctcttgcaagttggtcacaatgtattataagcattttgaatatgtcatcctctgtaatctcgtgaaaattttcggccttgtcttttagctcatcatatcggattcttgcagtaaccattttttgggcgagttctaataaccccaaagcttgcaattgctggtgagtatgatcactttcaaaaaatatcccacactccattccttcccaaccaacatattcatgccattcataaaccagcataaatgtttgtaaaactggcggtaataattggatatctgcaaaaccaaaccaaaacttacgcttgagatcccactcatattcaatcgccaatgctatattgtttaaggcatctccggcatccttatttttacgcaaaatcaattccgtcagtgtatagcgttgttcatcaatacgccgaagagcttctgcaatatcatagtttgtagccaacaaaacattctctgcttcctgatgagtgacgtctgcttttgccgtcaatatattgatttggtcaatatgaaacaacttgatggcttcatcaacatcaccgccagtcctctctaacaaacgtctggcaacctggataccgacaggtacgttcttccgaagtttacgaatttcacttaaccattccatgtcaaacccctttaaatatttatgatattaaatataacaacgtctggataacgacccggcctgactgaatatctcacgttttcctgcttaacattcatgttatgatgctcttgaaactaataatacgtatggaattgtcactatttatctgctaatgaattcaaacaatgtcattcgtttgatgaatatattatttcagggaataattatgacacctttagaacgcattacccaacttgttaatatcaatggtgatgttaataatcctgatactcctcgtccattgttatctcttgaggatttttttattgacaataatatccatggttcaatatgttgcaatgtgattccagaacaatctccgcaagctatctatcaccattttctgaaaatacgtgagcgtaacaatgttagtgatgttttggtagaaattacgatgttcgatgacccagactggccctttagtgaaagtattttagttatcaccactgcttcaccagaagaagttcagagctggtttgtagaagaaattgcccctgatgagtgctgggaaggatggtcagaagatacggagcatggatgggttgaagtccctgtgggtatgcatccggttacttgttggtgggattaaaacatttatataaacagataagcggatgtttacataaatttttatgtgaaggaacatgatgaaacttattcctcgcagtagtgatatttcacctggcattgatggaatttgcccggggccttttcctccgaacggatttaccgtacttacagatgcagcatatggtaacggagactgtttcggtttgtactggcctattggtcaggagcataaactacctatagtgtgcgaaacgtaccatgacgaatggcgaatcgtacctgccttttccagcattaagaagttcgaagaatggctggaagtgaatgatgatgatccccatgaaaatggcatcagcatcgaagatcaagactttgcagcaaatctcttccgtgttgctcggaaatgtctttcaacgggaaggcttgatgacgcactgccactgttacagcgagcaacagaacaattgcctgaagtcagcgaatattggttagcactggcaatccagtatcgccgatgtaaaaaaacagaagctgcagcacaggctgcgcttaatgcttatcttggcaattgggcatttggtgttcctgacaataaagtcattcatttgctgtcacaggccgcagatgtcccgaatttccaggatgatcctgtgattcagtgcattaaagaacaaggattagatcttagctttggaggaacaaaggaaaataataattaccccttgatgcagatgtgtgttgatacttattttgcgcagagaaaaccgcttcaggcattaaccctgttacataattatgcctggataatgtccagtgaaacgactgcatttcaggaacgctatgattttaatatcgatgaatggcgggcaaaattcaggcagttatgtttagagtattttggcgatagtcgtacacagttcacttaacgctctgcgtctatctactatcccttctttttcagaaaaaccgccgagcatgtcggcggctttctgacttacaaagtaacagattacatcagcggcattgccaaacgcacaatgctaatcagcggttgtggccatacacccagcaccagtaccaacagtgcagagatcagcacaacgataccgcccgcgctgtactgccagtttgatggtgcatcgcgacccggttgttccggggcgtgaagatacaggctcaccgccacgcgcaggtagtagtagaggccgattgccgaaccgacaaccacggcacccaccagccaccacaagtgtgcctggacaccgaccgccagcacgtagaacttaccgataaagcccagcgtcatcgggataccggccagagacagcatcatcaccgtcatcactgccgcgaggatcggacgatgccagaacagaccgcggtaagagaacagggaatcagcatccgggccacgatacgggctggacatcaggctgaccacgccgaacgcgccgaggctgctgaacagataaccggccaggtaaacccctaccgcttccatcgacatctcgccggtttgcagcgcaatcagcgctaccagcagatagccgaggtgagagatagatgagtaaccgagcagacgtttgatattggtctggctcagcgccatcaggttaccgaagatgatggaggcaaaggcgataatcgccagcaccacgcgaatcgcttcgctgtcacccaccggtgcgtagaggaacagacgcatcaccacaccgaagatagcgattttgctcgccgtcgccaggaaagtggaaaccggcgcaggcgcgccctggtatacgtctggcgtccacaggtggaacggcaccagagagagtttgaagccgaggccaacaatcatcaggccgaaacctgccagcaacagcggctcgttgagcataccgtcgccaaggtttttacccaacgcgacaaacgacaggtcgccagactgcgcatacaccagcgccataccaaacagcaggaaagaagacgctgcggcagaaaggatggtgtatttgatactggcttccagtgaacgtttctggcggaaagcgtaaccgaccaggccaaacagcggcaaagagatcagttcgataccgaggaacagagacgccagatggttggcattcgccagcaggatcccgcccagcgcggcaattaacaccaacaggtagaactcatccttgttgtcgttatagccttcaagccacgggtaggcgaaagtacaggtggcgaggctcgccaacaataccagcccggtgtaaagcatggcgaaaccatcaacgcgcatcagcggcgtaacgtccatagcgcccgcctggccaacaaaccagagcgaaaccagcgccgcgttaagcccaataaccgagagcgtagcgttgaggaaatgattgcgtcgccacgcaatggagagcatcacaaccaccaccgtcaagccgacgatcagcaacggtagcagtgcgatcaggttttgtggagttattgtcatggcgatttacggccttgtagtagtaacggaattaacaaaccactgctggatattgccaatcgcggagtgcgaggtatccagaatcggctgcggatagaagcccagcagtaccagcagcaccaccagcaacaggatcataaacagctcacgcagcgacatccctggcagttcctggctggcaatctggcttttcgctttaccgaagtaagcgcgatgtaacatcgccagcgaataaacagatgcaaagaccagcccaaaggtagagataacggtaatcaccggtacaacctggaagctgccgaacagaatcataaattcgccgacgaagttaccggtgccaggcatcccaagcgttgccaccgcaaagaacagcgacagtgctggcagccatttcatcttgctccacagaccgcccatcatgcgcatgtcgcgggtatggatacgttcataaagctgaccacaaagaataaacagacccgccgccgacaaaccgtgcgcaatcatctggattaccgcgccctggtaggccaactggctgccggtgtagatagcaatcagcacgaagcccatgtgggaaaccgaggtgtaggcgatcagacgtttgatatcggtctgggcgaaggccatccacgcaccgtagaagatgccgataacacccagccacatagcaattggcgcgaactctgccgacgcgttcgggaacagcggcagggagaaacgcagcaaaccgtaagcggcagttttcagcaagatccccgcgaggtcaacggaaccggcggtcggagcctgggagtgcgcatccggcagccagccatgcagcggaaccaccggcattttgactgcgaaggcgatgaagaagcccagcattaacaggtattccacaccactggacattggcgtattcagcagctcttcatagttgaaggtccagacgccggtcgcattgtagtgaacaaaaaccagcgccaggatggcaatcaacatcaccaggccactcgcctgggtgtaaatgaagaacttggttgccgccgtgatacgcgttttaccgtcagaggctttatgcccccacagtgcgatcaggaagtacatcggcaccagcatcatttcccagaagaagaagaacaggaacatgtcgatggcaaggaacacgccgataacgccgcccaggatccacatcaggttgaggtggaagaagccctgatatttttcgatctctttccacgaacatagtaccgccagcacaccgagcagaccggtcagcacgaccatcagcagcgacagcccgtcaatggcgagatgaatagagataccaaaacgcgggatccacggcatgtcgaattcagactgccactgcggaattccggcggattgcgtcagtgaataaccgccctgcaaccacagttgcagcgacagcgccagcgtcaatcccatggtgatcagcgcgatccagcgtggcaccttgacgccaaagcgttcggtctgccagcacaggaagccgccaataaagggaattaatattagccagggtagtaacatggcgatctttattccttgtaaaagtcccgtcaggaccggattttcaacgaattctcacgacagaaaattctcttcggactgggggtagtgtcggatgcaccgcgaaggcggcttatccgacctacgttcttatatgcccaggggcaatcccacaatccttaactcaacgcagtaccatcaacagtgccagcaccacgaccgcaccgatgctcatggatgccacataccagcgcagatagccgttctcacttaacagcagacctttacctgcaaagcgggaaaggacagccgggatgttcatcattgagttcagcggatcgcgtttcagcaaccaggcaatacccaggaacggcttgacgaacactttgtcatacagccagtcaaatccccaggcgttgtaccaccaggtgcccagcagacggcccggcgcactgttggcgatggaggtcaccagagtacgtttacccagccacagccaggctgccagcagaatgccgaccaccgcgaccacgccagaggtaatttccagggtcaacatgctgccgtgcgccagttccgtcgtttgcggaagcacgccctgcagcggcggtacaatcagtgcgccaacgaaggtggaaaggatcagcagcacaatcagcggcaggctgtgagttacccctttcacggcgtgagcgtgaatttgttcttttccgtggaagacgatgaaaatcatacggaaggtgtagagcgaggtcataaacgcaccgaccagacctgccaccatcagattgatatgaccattcgccatcgcacccgcgaggatctcatccttactgaagaagcccgcagtgaccagcggtagtgccgacagtgctgcgccgcccaccaggaagcagagataaaccagcggaatagatttacgcagaccgcccatcttgaagatgttctgttcgtgatggcaggccagaatgacggaaccggatgccaggaacagcagcgctttaaagaacgcgtgggtcatcaagtggaaaatcgccgcatcccatgcctgcacgccaagcgcgaggaacatgtagccaatctggctcatggtagagtaagcgagaacacgtttgatgtcggtctgtaccagcgcggcaaaaccggccagcagcagcgtaaccgccccgacaatacccaccagatgcagaacttccggcgtcatcaggaacaggccgtgggtacgggcgatcaggtagacacccgcggttaccatggttgcggcgtggatcagcgcggagacaggcgtcgggcccgccatcgcgtcggcaagccatgtctgcaacggcaactgcgcagatttaccgaccgcaccgcccagcagcatcagcgtcgcccacatcagcatgttattgccgtcagcaaagtgcgctggtgccagttccaccatttcgcggaagttcagggtgcccagttcgttgtaaagaatgaacagtgcgaaagcgaggaacacgtcacccacacgggtcacgacgaacgctttcattgccgctgcgccattcttcggatcggtgtaatagaacccgatcagcagataggagcacaggcccacgccttcccagccgaggtacatcagcagcaggttgtcggcaagcaccagaaccaccatgctggcgatgaacaggttggtgtaagcgaagaagcgagagtagccctcttcaccgcgcatataccaggaggcgtacatgtgaataaggaaacccacaccagtgaccaccgagagcatggtcagcgacaggccgtccagcaccaggttaaaaccgatgttaaagtcgcctaccgacatccacgtccacagcggctggctgtatgtctgctcgccgttagcgaagaaatcaacgccgataaaggcggttaccagcgccgccaggcccacagagcctacgccgacgatcgccgagacgttttcagaccagcgcccacgggagaatgccagcaggacgaagccaatcaatggcaaaataatggttaaggcaagcatgttcatccgcgcatctcacttactgaatcgatgttcaggttctggcgacgacggtgaagttgcagcagcagcgcaaggccgatactcgcttctgccgccgcgaggctgatggcgagaatgtacatcacctgaccgtcggtctggccccagtagcttccggcgaccacgaaggccagcgcggaggcgttaatcatgatttccagaccaatcaacataaacagcagattgcgacggataaccagaccggttaagccaagaacgaataagattgccgcgaggatcagtccatgttgtaaggggatcatgcgtgctcctccgtttttcttttcgcgctgtcgtctttacgattgctcagcacttcacccgcacgctcttcacgaccgacgtggaaggccacaaccagacctgcgagcagcagcatagaagccagttccaccgccagtacgtaaggcccgaacagcgtaatacccactgctttagcactgattggcgtaccgtcgataccctgatcgttaacaccgaggatggcgtaaacaatcaccaccagcatgatggccgacaaaattgccggaccaatccacacctgcggtttcagccactggcgttcctgttcgatttctgaaccgcccaggttgagcatcatcaccacgaacacgaacagcaccataatggcacccgcgtagacgataatttccagcgcaccggcgaagtaagcgcccagtgagaagaacaccccggaaatcgccagcagcgaaataatcaggtacagcagtgcgtgtaccggattggtatgggtgatcactcgcaaggtcgcaagtatggctatcaggccacagatataaaaagcgaactccattgcccctctccttacggtaacaggctcttgacgtcgataggcttggcttcgttctctgcttcgcccttatctttgccgtcgattgccatacctgccatccggtagaagttatattccgggtatttgcccggaccggagatcagcagatcctctttctcgtaaaccagatcctggcgcttgtattcccccatttcgaaatccggggttaactgaatcgccgtggtcggacaggcttcttcgcacagaccacagaaaatgcagcgtgagaagttgatgcggaaaaattccgggtaccagcgaccgtctttggtttctgctttttgcagcgagatacagccgaccgggcaggctaccgcgcagaggttacaggctacgcaacgctcttcgccgtccgggtcgcgggtcagaacgatacgaccacgataacggggcggcagatagaccggctcttccgggtacattcgcgtttcgcgtttggcgaacgcgtgcaggccgatcatccagatactacgaacctgggtgccgaaacctactaacaattcttttaaggtcatggtcttattgccccttattgcgcctgccagagaatgacagccgccgttaccagcaagttgatcagcgtcagcggcaggcagattttccagccgaaggacattacctggtcataacgcggacgcggtaacgacgcacgaatcaaaatgaacatcatcataaagaacgcggttttcagcgcgaaccagatgaatggcggtaacaacgggccttgccagccaccgaagaacagcgtcaccatcaatgcagagatggtcacaatcccgatgtactcacccacgaagaacagaccgaacttcataccggaatattcaatgtggtaaccatccgccagttcctgctcggcttccggctggtcaaacgggtgacggtgacataccgccacgcccgcgatggcaaaggtaataaaaccaaagaattgcgggataacgttccacacatgcgcctggctgttgacgatgtcggtcatgttgaatgaaccggcctgcgccaccacgcccatcaaggaaagcccgaggaacacttcgtagctcagggtctgcgcagaagcacgcatcgcacccagcaacgagtatttgttgttacttgaccagcccgcaaacagcaccgcgtaaaccgccagacctgccatcatcaggaagaacaaaatcccgatgttcaggtcggcaaccacccaacccggactgactggcacaatcgcaaaggccagcagcagcgaggtaaaggcaatcatcggtgccagggtaaagatgacgcgatccgagaatttcgggatccagtcttctttaaagaacattttgatcatgtccgcaaccagctggagcgaaccgccccagccaacacggttaggtccgtaacggttctggaacagacccagcaggcgacgttcgccaaagctcatgaatgccccgcaggtgacaaccaccagcaggatcaccaccgctttgaggatggtcagcaggatctcaatcagttccggtgatatccaactcattgttgtgcctccttgagatcctcaagatgcgcgccagccagcaccggagcaatgccggacatacccatcggcaagcccacctgccctgccgtcagtccttcggcgatttcaaccggcagcgtgaccgtgttgccatcgtaactaaaggagacgcgtgtacctgcgttcacacccaacttcgcggcatccgctgggttgagtttgatgtacggctgcggcatacggctctggaagaccggagcacgctgtgacaattcatcgctgccaaacaggtggtaatacggcgcgatacgccatttcccgtcctgcggctggaagcgtgccggtacgctggtgaagtaatccagaccattttcgctggtttcaaacagacgcacgcccggatcgccaaagcgcagtttgccgcccacttcgtcctggaatttgttccacgcctgcggggagttccagcccggcgcccaggcaaacggcacttgcgaacggtgcgcagtcggctggttgttaccttccatcgagaaggtgaacatggtgtcaatatcctgcggctgacgcggctcatgaacgctgatattggcgcgcatggcggtacgaccgctgtaacggtgcggttcacgggccagtttctgcccacgaatacggaatgtcgcatccggcgcagcatctttgatacctgccagttccgggattttcgccacaacagcgtcaatcacatggtcgagctgcgtccagtccacttcacggctcagcagggtgctgtgcagcgagtgtaaccagcgccagctttccagcatgacagttttgctgtcgtaataagcaggatcgtaaacctggaagaaacgttgggcgcggccttcgttgttgatcaccgtaccgtcgctttcagcaaagctggcagcagaaagtaccagatgggcgttttccataatcgctgtgcgttgatgatcaaccaccatcaccagcggtgctttagccagcgcagcattcacgcggatagcagaagcgtgacgatgcagatcgttttccaacaccaccaccgcgtcggcgcgtccggtttccagttcggttaacgcttcttcaagcgaaccgccacccataatgcccagccccatgctgttgacggaacgggcaatcatggtgataccgacgtcagcgccgcgacctttcagggctttcgcgacgttagccgccgcctgaatcacctctaagctaccggcgttcgtcccggagataatcaacggtttcttcgcacctgccagtgcctgcacgatgacgtcgattttgctttgcagctcaggttcgataccgtcaaccgctggtgcagagttatccagcgcatgggcgatggcaaaacctaaacgcgcctgatcttcaaccggtgcgcggtaagtccacgccgcgatatcatccagacgggtgtcatcaacgttggtaacaaacagcggatgcttcgcacgttgaccgatgttgaggattgccgcaatctgccagtcagccactttctgtgctgccgccatttcgcgcgctttacctttcacagcctgacgcactgccagcgcgacgcgcgcgccggtctgggtaacgtcttcgcccagcaccagtaccgcatcgtaagattcgatttcgcgcagagccggagtataaatgccgccttcacgcagcactttcagcgccagttgcagacgttcctgctcaccgtgagcgataccggtgtagaagttttcttcgcccaccagttcacgcagcgcaaagttgctttccacgctggcacgcggagaaccaataccgatcactttcttcgactgacgcagaatatctgccgcgccctgcattgcctgttcggcgttgagggtaatgaaatcatcgccacgacgctgtactggctgacgcggacgatccttcaggttgacgtaaccgtaaccgaaacgaccacggtcgcagaggaagtagtggtttaccgtaccgttgtaacggttttcgatacgacgcagttcgccgtaacgttcaccggggctgatgttacagccgatggaacattgctggcagatgctcggcgcaaactgcatatcccatttacggttgtaacgctcggagtgcgttttgtcggtaaatacgccggtcgggcaaatttcgaccaggttaccggaaaattcgctttccagcgtgccgtcttccgggcgaccgaagtagacgttgtcgtgcgcaccgtaaacgcccagatctgtaccgtcagcgtaatctttgtagtaacgcacacagcggtagcaggcgatgcagcggttcatttcgtgagagatgaatggccccaaatcctgattacggtgggtacgtttggtgaaacggtagcgacggaagctgtgtccggtcatcacagtcatatcctgaagatggcagttaccgccctcttcacataccggacagtcgtgcgggtggttggtcatcaaccactcgaccacgctttcacggaactgtttcgcttcttcgtcgtcaatggaaataaaggtgccatcggaagccggtgtcatacaggacatcaccaggcgaccacgcgtgtcttccgcgttttggtattgcttcaccgcacactggcggcaagcaccgacacttcccagcgccggatgccagcaaaagtaaggaatatcaaggcccagagacagacaagcttccagcaggttgtccgctccgttgacctcgtattctttgccgtctacatgaattgtagccattagcatgcttccagttttctcagtcagagactgagcgttaatcgaaattcggttaccagcgctctttcagcaggttcggctgaatcccattaatcaaatgggtattgctgaacggctgtttgattcccgcctcaaattcttcgcggaaatatttgatggcgctctgtaacggctccactgcaccaggtgcgtgggcacagaaagttttacccgggcctaagaatcgacacagttgctcaagtgtttcgatatcgcccggctgaccttcaccacgctccagcgcacgcagaattttcacgctccacggcagaccgtcgcggcacggcgtacaccagccgcaggactcacgggcgaaaaactcttccaggttacgcaccagcgacaccatgttgatctcatggtcaaccgccatcgccagcgccgtacccagacggctgcccgctttaccgatactttcgaattccatcggcagatcaaggtgcgcttcggtcaggaagtcagtccccgcgccgcctggctgccaggctttaaatttcagaccatcacgcataccaccggcgtaatcttcgaggatctcgcgtgcggtggtgccgaacggcagttcccacagtcccggatttttcacccgaccggagaagcccatcagcttggtgccagcatctttacttttcgagatgttctgataccactccacgccgttagcgaggatcgccggaacgttacacagggtttcgacgttgttgacacaggtcggtttaccccatgcgccggaggttgccgggaagggtggcttcgagcgtgggttagcacgacgtccttccagggagttgattaacgctgtttcttccccgcagatgtagcgccctgccccggtatggacgaacagttcgaaatcgaaacctgttcccataatgtttttgccaagcagacccgcttcggtggcttcggcaatggcacggcgcagattaactgccgcttcgatatattcgccacgcaggaagatgtagccacggtaagctttcagcgcaaacgcggagatgagcataccttccaccagcaggtgcggcagttgctccatcaacaggcggtctttataggtgcccggctccatttcatcggcattacacagcaggtaacggatgttcatggattcgtctttcggcatcaggctccatttcaggccagtcgagaagcccgcgccgccgcgccctttcagaccagcgtcttttacctgattaacgatttcgtccggagacagcccggtcagcgccttacgcgcgccttcgtaaccgtttttgctgcggtattcgtccagccacactggctgtttgtcatcgcgcagacgccaggtcagcggatgcgtttcgggagtacggataatgtttttcatttataccgctccagcagttcagggatcgcttccggggtcagatgcgcgtgagtgtcctcatcgatcatcatgtttggccctttatcacagttccccaggcagcaagttggcagcagcgtaaagcggccatcaaatgtcgtttgccctggtttgatgttcagctttttctcgagcgccgcctgaataccctgataaccgttgatatgacagaccacgctgtcacaataacggatcacatggcgaccaaccggctggcggaagatctgactgtagaacgttgccacaccttcgacgtcgcttgccggaatacccagcacatcggcgatcgcgtggatcgcaccatccggcacccagccacgctgcttctgaacgattttcagcgcttcaatggacgccgcacgcgggtcttcgtagtggtgcatctcgtgctcgatcgcttcacgctctgccgcactcagctcaaaagcctcggtttgtggttgttgattctcgtgcataattagcggtccacatctgacataacaaaatcgatactgcccagataaacaatcaggtcagacaccaggctgccgcggatcgccgccggaatttgctgcaaatgcgcaaagctcggggtacgaacacgggtgcggtaactcatggtgctgccgtcgctggtcaggtagtaactgttgatccctttggtcgcctcaatcatctggaaagattcattggcaggcatcaccggaccccacgacacttgcaggaagtgggtgatcagggtttcgatatgttgcagcgtgcgctctttcggcggcggcgtggtcagcgggtgatccgctttgaacgggccttccggcatgttgttgaggcactgctcaagaatgcgcagactctggcgcagctcttccactttaagcattacgcgggtgtagcagtcagaaacgccaccacccaccgggatttcaaagtcgaagttttcatagccagaataaggacgcgccttacgcacgtcgaagtcgatcccggtagcacgcaggcccgcgccagtggtgccccactccagcgcctctttcgcgccataggcggcaacgccctgggaacgacctttcagaatggtgttttgcagcgccgctttctcgtaagacgccagacgtttcggcatccagtcgaggaactcacgcagcaggcgatcccagccgcgcggcaggtcgtgcgctacgccgccaatacggaaccacgccgggtgcatacggaaaccagtgattgcttccaccagatcgtaaattttctgacgatcggtaaaggcgaagaacactggcgtcattgcgccgacgtcctgaataaaggtcgagatatacagcaggtgactgttgatgcggaacagttcggagagcataacgcgaatgacgttaacgcgatccggcacggtgatcccggccagtttctctaccgccagcacgtaaggcatttcgttaacgcagccgccgaggtattcgatacggtcagtatacggaatgtagctgtgccaggactggcgttcgcccattttctccgcaccacggtggtggtaaccgatgtctggtacgcagtcgacaatctcttcgccatcgagttgcaaaacgatacggaaagccccgtgcgccgacgggtggttcggaccgaggttgaggaacatgaagtcctcgttttcggtgccgcgcttcatcccccactcttccggtttgaaggtcagggcttccatctccagatcctgtttggctttggtcagctcaaacggcgagaattcggtagcgcgcgccggataatctttacgcagcgggtgacctttccaggtttgcggcatcatgatgcgtcgcaggttcgggtgaccgtcgaaagtaatgccaaacagatcccaggtttcacgctcataccagttagcgttcgggaacagtttggtgaaggtcggtacgtgcaggtcgttttctgccagcgccaccttcagcatgatgtcgcggttacgatcgatagaaatcagatggtagaaaacggaaaaatccgcggcaggtaacccttcgcggtgtgtgcgcagacgttcgtccatgccgtgtaagtcaaacagcatgacgtaaggtttcggcagtttctttaagaaatcgccaacttccagtaattgttcacgcttgatccacacaacgggaaccccggtgcgagtcgcctgaacagtaaaggcatccggcccaaaacggttgcgcagttcgccaatcaccggatcatcaagatgatcgcgggtctgccaggcgggttcttgcgcggttaagtcggtcatattgttcaccattgcaaatggtccgtggtgactgtcggcgcagtaagcttcgcgaaatagatttaggaataagcgaagaaaaatccctttgccgacaggcgcaaattaaatctcgtcaggtgtacgcaggttagttacggcaatgcgttcaccgcgcttgcgttcgcgctctgattgcatattggcgcgataaacgccctgatcgccaaccacccaggagagcggacgacgttctttgccgatagattcctgcaacagcatcagtgcctgcatgtacgcttcaggacgcggcgggcagcccgggatatacacatcaaccgggatgaatttatcgacgccctgcacaacggaataaatatcgtacataccaccagagttggcacaggcacccattgagataacccattttggttccagcatctggtcatacagacgctgaataaccggtgccattttggtaaagcaggttcctgcaaccaccatcaggtcagcctgacgcggcgaagcacgcaatacttctgcgccaaaacgcgccacgtcatgcaccgcggtaaacgaagtcaccatctcaacgtaacagcaggaaagaccgaagttatacggccaaattgagtttttacgaccccagttaaccatgtcattgagcttgcccataaacacgtttttgttaacttcttgctccagagggtcggttacgatctcctgcttttgcagggggtaacggtcgttctcaccgttgggatctatgcgggtgagcgtataatccatcttaatgcctcgcggttagcgttgacgattagcgatactgttcgtttccgggttcatacgctcgcggcgtgaacgcgcgggcgtccagtccagcgcgccaatacgcaccagataaaccagacctgccagtaacacaaaaataaaaattgcagcttccacaaagcctacccagccgctttcgcggatagaggttgaccatgcgaacagatacagcgcttcaacgtcgaagataacgaagaacatggccaccagataaaacttggcggacaggcgtaagcgggcggagccgaccgagtcgataccggattcaaacggcacgtttttcgacctcgcgcgtgcgcgaccgcctaaaaaccaaccgcctaccagcatcaggcaacacaggccaatggcaacgataagaaagatagcgaatgcccagtgatgagcgatgacttcagtggatgttgacatactcattgcttactcatcaaaagtagcgccagattcactgctcttcacggcagatggacgccacatcgattcatggggaggaataaaaaaaaccttacaatcactgtagaaattcttttatacagctaattgatgtggttttttactcctttctataaccttttgtcaactttaacaaaagtttcttcacattagtttacataatatcaacaccattagcatttaatgccctttcaccccagatccttgacgactccaggataattagatgttgttgaatcgtgtccgttgtgaagcaatggaaaaaatacgggtctattttgacaggaatttgtgtcgattcctccccccaaaagagagtattttcttgatctgtgacacgcttttgtcattccataacaaaaacgcagcaacaaatttacgtattttttaacatcattgtagcaggtgatttttttcaggcgattatttgtgcgttcgggacgtgaatctctggtggttgaaaaatgaacagttttgtacgttctgcactatgcgatgaaggatttttactaaaaaaaagccgctggggtttaaaacacccccagcggctcgttttttacactattgtctcaggaattatctatcgtccgtcgattactcgatatccctttcaatcaacaatgaatcatccccttccggagcagacattgggctgtattgccacggattatggtagctctccatcgcctgatagatcacctgggccagctcattattactggacggatcatagcacagcaaatattcggtatcaggtagcggcggtaagccatctactccactcagcacacgcaggtccgggctcatcatctcaaccggccttgccgtcacgccaagaccggctttcactgccgcacgaacggccggaagcgtcgaggcgacataagccagtcgccatggaatatctgctttattaagcgtcgccagcaccatatcgcgaaacgggctaggatcatccagcaatacaagagggatcggctcgcctttttgcaatatgtattccgctgcgcagtaccagtgtgttggcgaggtacgcaggttcaatgccttaaacgctgaaggacgatgggtggttaccatcaaatccacttcctgggattccagcatttctgccatataggcattacgtttaacgcggacatccagcgctaatttcggataaaccgaactcacgcgatttaacaggaaaggtaagatcgtatcggcagattcatctgaagcaccgatagttaatacgccctgaagattactgaacattaatgatgagcaggcctcatcattaaaacgcaggattttcctggcgtaaccaagaagttgaatgccatgttcagttaacagtttgttgcgaccgtgacgagcgaacagttctttcccaacgagttgttccagacgctgcatttgctgacttacggcggactgagtacgacacacagcggcagctgcggcagcaaaagtgttcagatcggcaacagcaacaaatgttctcagcagatcgaggtcgaggttaattatcggacgatttgcacttatcatatattatcacttactggcggctcatactgagctggttaatgctgtgcacacacaaacaagcaattccatttgtaatgtgcctccctggcagtttcatccggaacccggacgaaagtaaaaatgcatatgagttgcactaaaaaagcgactcacattgttccgttataatgcctgaagtagatcacagaatatatcttcagggatcgcatatctattaagttactcactcttttctatttatgacatgcgcgtgtttgtataaatgtaaatgtgagtccttgttccactctcgtgcagcatcgctggtcatacgcgaacacgtaccaacagcaatggtgaggcggcatcaagagcagggatccgtcatttatccgagcattttaccccaaaaaccttttatttataagggtcattgcgaattatctgatgcaaagttatgttatgttaggcaaagtaatcttctattattaataagcacatcaaaacctttttgaatattaaataataattaattagcatcatcctcattcattaattccgcttaacaatagtttcacaccttgcccccattgcgacacctcggaaatcatcacgcagttaaactctccgtaatgaggaaatatcatcatcgcgtttcattagtgaattcttaaatgaggcattttcacacaattatcttacagataaaaaaaccagacttacaattaagaatcagaacaattcactatataacattgcatgtaaagcatatacacctcattattttgtcattattaagttattaacagcacaatcgagccttcccctctggcaaaatcttattctgcagaccttcaaaacaccgtcctgggggagtacattgttctaagctgacttccacggcagggagtggcgataacagcaaaaaaggtcaagattcatgtcccccattgaaaaatccagcaaattagagaatgtctgttatgacatccgtggtccggtgctgaaagaagcaaaacgcctggaagaagaaggtaacaaggtactgaaactgaacatcggcaacccagccccgttcggttttgacgcgccagatgaaatcctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcaccagattacccactctggaccgcggcggtttcgctttccagcggtaaagcggtgcattatctttgcgatgaatcctctgactggttcccggacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactcaattgcgccgctggcacctgacctgctgaccattacctttaacggactgtcgaaaacgtaccgcgttgcaggcttccgtcaggggtggatggtgttgaacgggccgaaaaaacacgccaaaggctacatcgaaggtctggaaatgctggcttcaatgcgcctgtgtgctaacgttcctgcgcaacacgccattcagaccgcgctaggtggttatcagagcatcagtgaatttattacccctggcggtcgtctttatgagcagcgtaaccgcgcgtgggaactgatcaacgatattccgggcgtttcctgcgtgaaacctcgtggtgcgctgtatatgttcccgaaaatcgacgccaaacgctttaacattcacgacgatcagaaaatggtgttggatttcctgttgcaggaaaaagttctgttggtgcaagggacggcattcaactggccgtggccggatcacttccgcattgtcacgctaccgcgtgtcgatgatatcgagctgtctttgagcaagttcgcgcgtttcctttctggttatcatcagctgtaatcttaatttcactgccggagattgcatccggcagcgttatcccgccacaatgacctgatgatgtcatcatacgtaaggtcactatgaaacagagccatttttttgcccatctctcccgcctgaaactcattaaccgctggccgctcatgcgcaacgtgcggacggaaaatgtgtccgaacacagtttgcaggtagcgatggtcgcccatgcgctggcagctatcaaaaatcgaaaatttggcggtaatgtcaacgccgaacgtatcgctttactggcgatgtaccacgatgcctcagaagtgctcaccggcgatctccctactccggtgaaatacttcaattcgcaaatcgctcaggagtacaaggctattgaaaaaatcgctcagcaaaaactggtcgatatggttccggaagagctgcgggatatctttgcgccgttaattgacgagcatgcatatagcgatgaagaaaaatcgctggtgaaacaggcagatgcactgtgtgcatatctgaaatgtctggaagaactcgcggccggaaataatgaattcttgctggcaaaaacgcgactggaagcgacgcttgaagcgcgtcgcagccaggagatggactacttcatggaaatatttgttcccagcttccatctttcgctcgatgagattagccaggattcaccgctgtaagcagccggagtctgcgtcgcatcaggcaataagcgccggatgcgacatcaggctcttgtcaaaacggaaacagcatcgggatcatcaccacacaaaccgccatcacgataatggtgaacggtacccccaacttcacaaagtcactgaagctgtaatttcccggacctaaaaccagtgtgttaacaggtgaagaaaccggtgtcataaaggcggcggatgctgccatcgccacgaccatcgcgaatggataaggcgacacccccatcgttttggcagcagccagcgcaatcggagccatcaacaccgccgtcgcggtattagagataaatagcccaataaccgccgacaagacaaacaaacaccccagcatcatatgtggcccgtaaccaccgccaatgtccatcagccctttcaccgccagcgcgacacctcccgttttctgtaatgccacagcaaacggcatcatcccaacgatcaaaataatgctcggccagtgaatggatttataggcgctttcagcatctatacagcggaatttccccatcagcaggcaggcgatgatagcggcaacaggattaggaatttcatctgtcagcattaacgccaccattagcaccagacagaaaatggcatggggtgcctggctgtgcgcgggtgatgcttcactcacctcttccggtaagttcagcgctacgaagtcgcggccctgtttggccagcataccgatcagtttccagttacccacaaccaggatgatatcgcccagcagcagaggctcatccgccagcgaaccttccagcgccacgccattgcgctttagccccaccacattcagtccgtagcgggtacgaaaaccaatttcgcgcaccgatttaccaatcagttctgactcaggaattaatgaaatctctgccatgcccacatcaagggcctggtcagaaaaatactcgccgcgcagtaccatcggctccagcaattgctcactacaaaattgccggagatcgacatcagccgcagacatatcaataagcaaaacgtcacgcgcgcgaaattcagaaaccccattaacgttcacgataacgcgacgaaaacgccgccagcgttcaacaccgatgacgttagcgccataacgctcacgtaatttgagatcatccagccgttgaccaatcattggcgatccggggcgaatagccagacgtcgcgcacgcccggtcagtcgatattcacggataagatcgcgaaaggttcgacgcgtccagccttcgcgctgcggggtctgggtatcccctttcagcatgaaacgcatcactaacatatacaaaatacccagcaccagcacgaccaggccaataggtgttacgctaaagaaactgaagccgtgatagccttcacgcagcaattcactgttgactaccaggttcggcggcgtcgccaccagcgtcatcatgccgctaatcagcccggcaaaacttaacggcatcatcagacgtgacggcgacgtttgcatacgcatggcaacgcttaacaccacgggaataaagatagcgacaacgccggttgaactcataaacgcgccaagccccgcgacggtcagcatcaacaaaaccaacattttgatttcactattgcccgcaactttgaccagccatgttcccattacggtggcaacaccggtacggaccaaaccatcgccaataataaacaaggcggcaatcaggacaacgttaggatcagaaaagccggaaaatacttctgggactgtcagcgttccgcttaatgcaaacgcgacaataacaaacaaagcgaccgcatccatacgcactctgcccgtcgcaaacaagacgatggcaacggccagtaatgaaagaacccaaatcaattcaccgttcacaacttatccttgttaattgagggggatgacttgattctgccataaaaaagccccgacgagacggggctaaatcatgatcaggtgtttcactgaataataacatcgccatttggctgtttggtcacagtaatttgctccagactgtggaggaccaaatcgacctcattcaggcgcggggtatctgccggagcgttaaccgcaatgacatgacaacccgccgccaggccagaaagcacgccagcgggagcatcttccaccaccacacactcctgcggcgcaagccccagcagctgcgcgcctaacagatacgcatcaggttctggttttccgcgcttcactcgctcagcggttacaaacacctctggtgcgggaagcccagctattttatggcgcgctcgcgctaccggcatggagccagaagtcacaatggcccacggaatacctgctttattcaaatgactgagtaaggcgattgcccccggaagcgcggtaataccttcggtttccgtggcctcgatgtgctccagacgcgtaaactcggcggcaatatcagcctcggatttgcccgccataaaatggcgcagagaggtgatcgcctgtttaccgtgaatgaaagccagcacctcttccggcgctaacccatgacgtctggcccagttgctccacgcccgttctaccgcaggcagggaatccaccagcgttccatcaagatcaaacagaaaacctttgcaccgcacgcgggcctcctcaggcattgataatttgattaatttcgttggcgctcaaatggtactgacgcgggcaggcatgccacacattaagcatgcgctgatatttttcccacattggcgtctgggcgttaaaaccgtgagttccggcgtcaaaatgggtatagcgcccttccacattaaccataaagcggacataaccgaggtaacgtgcttcagtggcggcgtcaaagccgaggaaggtgacacgacgttcatcgatggattgctggtcctgcaaattagaccaggaaacatgcaacgcatgatacatctccataatgtcgatgatagtgcggcaggtttcttctttcagctcgccaaactcgcgatccaattcacgcatctgtaatccgtaaccacgctcaataattgtttgcaggcgacggtaacgttcagcatttgccggatcgagcatagtcatcatcttgtactgattagacaaaataagacgttgcgcgttggtcatttccattgttgactcctgtatcactctactacggtgaaaaaaaagaaggctgagtatgccttcttttatatgcgtaatcaggggtcaattacaaatcatcaaggaaagttttatccagttgtttgaaggcgcgcttaagcgtgtcagctaatgcctggtaatcaggcttgccttcaacgggtgccaacacctgtccagactcctgcaatttaccgcgaacttcataaaaccagttaaggattgcagggggtaatggcgtgacagaacgcttgcccagccaccacaatccctgcatgggtaaacttaaggcgaacagggcagtggcaactgccggcccaagctgaccgcccagggcaatctgccagcagagagtaaatacggcgatcggcggcataaaacggatcgcataacgcgtcatcttgataacgcgattttcgacaaagaccggggcaaggcgtttttccagcggccacgtctttgagtaatgctgtccccggcgaaacaagctaaaaaaattaacagaacgattatccggcgttgacatgcttcacctcaacttcacatataaagattcaaaaatttgtgcaaattcacaactcagcgggacaacgttcaaaacattttgtcttccatacccactatcaggtatcctttagcagcctgaaggcctaagtagtacatattcattgagtcgtcaaattcatatacattatgccattggctgaaaattacgcaaaatggcatagactcaagatatttcttccatcatgcaaaaaaaatttgcagtgcatgatgttaatcataaatgtcggtgtcatcatgcgctacgctctatggctccctgacgtttttttagccacgtatcaattataggtacttccatgtcgagtaagttagtactggttctgaactgcggtagttcttcactgaaatttgccatcatcgatgcagtaaatggtgaagagtacctttctggtttagccgaatgtttccacctgcccgaagcacgtatcaaatggaaaatggacggcaataaacaggaagcggctttaggtgcaggcgccgctcacagcgaagcgctcaactttatcgttaatactattctggcacaaaaaccagaactgtctgcgcagctgactgctatcggtcaccgtatcgtacacggcggcgaaaagtataccagctccgtagtgatcgatgagtctgttattcagggtatcaaagatgcagcttcttttgcaccgctgcacaacccggctcacctgatcggtatcgaagaagctctgaaatctttcccacagctgaaagacaaaaacgttgctgtatttgacaccgcgttccaccagactatgccggaagagtcttacctctacgccctgccttacaacctgtacaaagagcacggcatccgtcgttacggcgcgcacggcaccagccacttctatgtaacccaggaagcggcaaaaatgctgaacaaaccggtagaagaactgaacatcatcacctgccacctgggcaacggtggttccgtttctgctatccgcaacggtaaatgcgttgacacctctatgggcctgaccccgctggaaggtctggtcatgggtacccgttctggtgatatcgatccggcgatcatcttccacctgcacgacaccctgggcatgagcgttgacgcaatcaacaaactgctgaccaaagagtctggcctgctgggtctgaccgaagtgaccagcgactgccgctatgttgaagacaactacgcgacgaaagaagacgcgaagcgcgcaatggacgtttactgccaccgcctggcgaaatacatcggtgcctacactgcgctgatggatggtcgtctggacgctgttgtattcactggtggtatcggtgaaaatgccgcaatggttcgtgaactgtctctgggcaaactgggcgtgctgggctttgaagttgatcatgaacgcaacctggctgcacgtttcggcaaatctggtttcatcaacaaagaaggtacccgtcctgcggtggttatcccaaccaacgaagaactggttatcgcgcaagacgcgagccgcctgactgcctgatttcacaccgccagctcagctggcggtgctgttttgtaacccgccaaatcggcggtaacgaaagaggataaaccgtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaatctcgtcatcatccgcagctttgcgctgcggatatctgaaccggaaataatcactatttccggttttttattctcttaatttgcattaatcctttctgattatcttgcttaactgcgctgcatcaatgaattgcgccatcccactttgcatacttaccactttgttttgtgcaagggaatatttgcgctatgtccgcaatcactgaatccaaaccaacaagaagatgggcaatgcccgatacgttggtgattatcttttttgttgctattttaaccagccttgccacctgggtagttccggtggggatgtttgacagtcaggaagtgcagtatcaggttgatggtcaaacaaaaacacgcaaagtcgtagatccacactcatttcgcattctgactaacgaagcaggcgaacctgagtatcaccgcgtacagctgttcacgacgggcgatgaacgcccgggcctgatgaacttcccgtttgaaggattaacctcaggatcgaaatacgggacagccgttggcatcatcatgtttatgctggtgattggcggcgcgtttggcattgtgatgcgtacaggaaccattgataacggtatcctggcgcttattcgccatacccgcgggaatgaaattctctttattcctgcgctgtttattctgttttcacttggcggcgcggtatttggtatgggagaagaggccgtcgcctttgccattatcatcgcaccgctaatggtccggctgggctatgacagtattaccaccgtcctggtgacctatattgccacgcaaatcggttttgccagttcgtggatgaacccgttttgtgtggtcgttgctcaggggattgccggcgttccggtgctttctggctccgggttgcgcatcgtggtgtgggttatcgccactctgattggcctgatctttaccatggtgtacgcctcacgagtgaaaaagaatcctcttctgtcacgcgtgcatgagtccgaccgcttctttcgtgaaaagcaggctgatgttgaacaacgtccgtttacctttggtgactggctggtattgattgtcctgaccgccgtaatggtctgggtgatttggggcgtgatcgttaatgcctggtttattccagaaattgccagccagttcttcaccatgggtctggtgattggcatcatcggcgttgttttccgccttaacggcatgacggttaataccatggcttcatcctttaccgaaggggcgcgaatgatgatcgcccctgccctgctggtgggtttcgccaaagggattttgctgctggtcggtaatggtgaagcgggtgatgccagcgtgttaaataccatcctcaacagcattgccaatgccattagcggtctggacaacgcggtcgcggcctggtttatgttgctcttccaggcggtatttaatttcttcgtgacgtccggttctggtcaggcggcgttaaccatgccgttactggcaccgcttggcgatctggtcggtgttaaccgtcaggttaccgtgctggcgttccagtttggtgatggcttcagtcacatcatttacccaacctcagcgtcgttaatggcaacgctcggtgtgtgcagggtggacttccgtaactggctgaaggtgggcgcgaccctacttggactgctgtttattatgtccagcgtcgtagtgatcggcgctcagttgatgggctaccactaaaaatgttaagagccgcaattgcggctcttttttcattctgccgtttcagtctctacggcttcatttttggcattgcgcttcatccacaacgctagcgctttcagcgagtctggagtgaactcatcgcagcgtgcggtgatttcttccggcgtcagccagcaaacttcactgacttcatcttcctgtagtgcgaagggaccgtgagagacgcagctgaacaatgcgccccagacacggcaatttttatcttcgaaatagaactgcccgtgctcggcaaaggggacaccggcaatgcccaactcttcttccgcttcgcgacgcgcggattccagcagttgctcatcggcctggactacaccgcctgcggtcgcatctaacatgccgggtaaaaagtcttttgtctcggtacgacgctggaccagaattttgcccatgccatcatgcacgacgatgtaagttgcacgatgacgcagacactgtgcccgcatttgttcccggctggcttgtgcaatgacttcgttctcttcattgacaatatccacccattcagtacttgccaaacgacgctgttccattatcaggaaaccttctttttctggcgctcttacggcgcattttgagttgtgggtaaattacggattaatcgcgacctgcgcaatgatactttgatcattgagtgcgattacactaagtacgtcattatccagcatgccataactcgccggattaccgcctttcggaatactcaccgagccggggttgaagtggaaaatctccccccgctgttctgccactggcagatgggtatgaccgtacaccagcacatcgttctggtttaaagcaggcagattttccgggccaaaaagatgaccatgcgtcaaaaacagacgttgtttttccagtaatacctgttgccacggcgcggttatcgggaaatgcagcagcatttgatccacttcgctgtcgcagttgccgcgcacagcgataaccttatgtgccacttcattaagccgttcagcgactttggctggcgcgtaaccctccggtaaagcattacgcgggccgtgattcaacacgtcgccaaggatcaccagccactgggcaccgctttgggcaaacaactccagaacacgttccgtcgccggtaacgacccatgaatgtccgatgcaaacatcagtttcatcactcactcctcgtcgaaaaaacgtaagctatgatactggattctgtcgttgctatcagccagattgcttcgccgaaagtgcaataaaacgctggacagacgctcgctgccactggaatgttgcataatccaccaggcgttctggcacctcatcgccatgtagtaccaggcggttaatcattagcgccagatcagtatcagcaatgcaccattcaccaaataaattcggctgacccagtactaacaaatgttctgccatcgcgaacagtttctctgcactggcttttccctcggccgttagtggcgcttttttcgcccccgcaaagacaacatccgtcggacgctcttcgcggatgggcatcagatcgctgcgcagccaggcctgaatctgtcgtgcacgcgcacgattttctaaatcaagcggataaatacgttcccaggtcggtggcgcaaatcgatcttccagatactccgcaatggcagaagattcactcaactcaaaatcatcgatttgtaataacggcacacggcgtgtctgaccgtaaccttgccacgtcggctgcaaatgttcaccgctgtcgaggtcgatggtcttgatatgaaacgacaggcctttttcctgcaacgccacccaggcggataacacataaggggagaaaaagtgggcatctgaccaaagcgtgatagcgggtttactcattatgtcctcggcaataaagggggctggctatcaaactatagagcctttttgtcactgtcacgtgacgaatactcacgtaagtcgccgcgctttctatacttgtggtgttcagatgattaaacaaccggagctgcaatgatcgatctctatttcgccccgacacccaatggtcacaaaattacgctgtttctcgaagaagcagagctggattatcgcttgattaaggtagacctggggaaaggcggtcagtttcgtccggaatttttgcgcatttcgcccaacaacaaaattccggcaattgttgatcattctcctgccgatggcggcgaaccgctaagcctctttgagtctggtgccattttgttgtatctggctgagaaaacaggactctttttgagtcatgaaacgcgtgagcgcgccgccacattacagtggttattctggcaggtaggcggactggggccgatgcttgggcaaaatcatcattttaatcacgcagccccccaaaccattccttacgctattgaacgttatcaggttgaaactcagcgtctttaccatgtactgaacaagcggctggaaaactcgccctggctgggaggcgagaactacagcattgcggatattgcctgctggccgtgggttaatgcctggactcgccagcgaattgacctagcaatgtatccggcagtcaagaactggcatgagcggatccgttcgcgccctgccaccgggcaggcactgctaaaagcacaactcggtgatgagcgttcggatagttaacagaaacaggttctcgtgtattatttcatcctaagtaaaacaacggagaacctgcaatggcacaacctgccgctattattcgtataaagaaccttcgtttgcgtacgtttatcggaattaaggaagaagaaattaacaaccgtcaggatattgttatcaatgtgacgatccactaccccgccgataaagcgcgcactagcgaagatatcaacgatgcgctgaattatcgcaccgtaacgaaaaacattattcagcatgtagagaataaccgtttctctttgctggaaaaattaactcaggatgtgctcgatatcgcacgtgaacatcactgggtgacgtatgctgaagtggagatcgataaactgcacgcgctgcgctacgccgattcggtatccatgaccttaagctggcagcgttaatcgccatatcgggaggctgcatgaacatagtgatcaccggagggacaggattaattggtcgccatttgattccgcgtttgctggagctgggccatcaaattacggtagtgacgcgtaacccgcagaaagccagttccgttctcggccctcgggtgacactatggcaagggcttgccgatcaaagcaacctcaacggcgttgatgcggtaatcaacctggccggagaaccgattgctgataaacgctggactcacgagcaaaaagagcgtctctgccaaagccgctggaatatcacgcaaaaactggtcgatttgattaatgccagcgacacgccaccgtcggtactcatttccggctcggcaacgggctattatggtgacttaggtgaagtggtggttaccgaagaggaaccgccgcataacgaatttacccataaactctgcgctcgctgggaagaaattgcctgccgggcgcaaagtgacaaaacgcgagtgtgcctgctgcgtaccggtgtagtgctggcaccggatggcggtattctcggtaaaatgctgccgccgtttcgtcttggcctgggcgggccgattggctctggtcggcagtatctggcctggattcatattgatgatatggtcaacggtattctctggctgctggataacgagctgcgcgggccatttaatatggtttcgccctacccggtacgcaatgaacaatttgcccatgcgctcggtcatgcgctgcatcgcccggccattttgcgcgtccccgcgaccgccattcgactgttaatgggcgaatcttcagtactggtattaggtggacaacgcgcgctgcctaaacggctggaagaagcgggttttgcgtttcgctggtacgatttagaagaggcgctggcggatgtcgttcgctgatgtggtttacagcaaacatccgccagttaactcccggtgttacaggattagtggctttgcgcgataagatcgtctggtgaaagtcgggtcaccatcataactaactctctgtctaaacctctatccagcatctcctgagcaatacgcagggcttcttcgtgtttgccctgcattgcgccttcttcacgtaatctgtcagcaatggtcatcagtttctccttttcttgtggtgcgcgttccgctatctcaccaataaatgcacgaaaacgctgggcatcccctgtttgtaatacgtaattaaacagggcttttagctgtctgtcattagtgttccctgtaactagcagcgaaacaatttggtcgactaatcccaacagatcgcgctgacgaatatgtttctgaattaactccaacagcgccattttgcggtgttgcataatctcgtcatccggcaccacggtaatatccaccaacggaaaagccgatgaatatattttgcgggctatagcaggctcggcaaattcatcaagccagcagagtgaataaggataaggacttctgcaaccatgataaaacagcatcgggagcaccaatggaagctctttatagcccgcatcaagatggttttgcattgccgcaatggaataacgcatcatgcgaaaagccattaattcttccggcttactttggtgctctatcactacataaatataacccactccctcctgcgttttcacagaccacaagaggtcggaataatattgccgcaggtcttcatcaataaaactgtttggttccagtttaagcgtcgttaaatcacacagtttgcgcagcggcgcgggaagatgaatatcaataaaatcccgcgcggtgtctggatggcgtaaaaaagatttaaataccgcatcatgcggcgtggaagttgtcgatattgtcatggcgttccgtcacccctcaaatttaagatgacgcgacaataaccacgattaacacccaatgcagcaggcagtttttatctttggacagcgaattcagaagtatttttagcggactgtaacttttacatttcagcggaagctgactcgcaaattccccatgaaaatactccggcagcgttagccaccggagaggaaattatttcagcgatcccttaaggaaccgttgcagacgagggctttgcgggttgccaaataactgctccggcgcgccctcttcttctattttcccctgatggaggaaaatgacatgagtagaaacatggcgagcaaagcccatttcgtgagtcactaccaccatggttttcccctcttctgccagttgctgcataatacgcaacacttcgcctaccagttcaggatcgagcgccgaggtaggttcatcaaacagtaaaacttccggttccatcgccagcgcccgcgcgatagaaacacgctgttgctgaccgccggaaagatgcaccggatatttcccctgcgcacgttcgtctatcccgacttttgccagatacttcaccgcccgctcgcgcgcttcctgcttgctcaggcccaacacctgaatcggcgcttccatgacgttttccagcaccgtcatatggctccagagattgaagtgctggaataccatcgtcaggcgtgtgcgcagtaagcgcagttgatttttatcggcgactttgagttgaccgtctttgtcgcgcaccagattgatcgtctggccattgaccacgatcgacccttcactcggtttttcgaggaagttaatgcagcgcagaaaggtacttttccccgatcccgacgatccgatgatgcttattacatctccggcattcgcttgcagtgatacccctttcagcacttcatgttcgccgtagcgtttgtgcaaatcgataacgtttaatttattctcggacatcgtattctcagtgcgttgaagaaggtttcacatgctgcaaccagcgtttttccgctctgcgaaagaggctgatcaggacataagagatgattaaatagagcaccgcggcaatgccgaaggcggtaaaaggttgatacgtggcggcgttaatatcgcgggctattttcagcagatccggcaccgtggcagtaaatgccaacgcagtagagtgcagcatcaggatcacttcgttgctgtatgccggtaacgcaatacgcagcgcagaaggcaaaataatgcagcgatacattttaaaagtcgagaagccataggctctggcggcttcaatttccccatgcggaaccgaacggattgccccagcaaaaatctcggtagtgtaagcgcaggtgttaagcgtcagcgccagcacggtacagttcaggccactgcggaagaaagcgttaaggaattcggttcccttaacaatctcaagcgtgtacatgccggaatagaacaccagcaactgaacatacagcggcgtaccgcgaaaaatataggtaaataaccagattggaaactggatgtatttattactggagacacgaccaatcgccagaaacagcgccaggactccgcctatcactaccgacaaaataagcagccacagagtgatcgccacaccagtaaagcgataaccgtcggtccacagcagcggtttccagtattcatgtaagatttcgatcacaggtcagccctcttcacacccacggagtagcggcgctcaaggaacagcagcacaccattggaaacagtggtgaaaaccaggtaaatcacgccacagacgatggcgaaatagaacggttcccaggtacttttgcctgccagttgggtggctttgaccacatcttccaggccgagtaacgaaaccagtgcggtagatttgaggatcacctgccagttgttgccaatgcctggcagggcgtaacgcatcatcgacggaaacatgatccgccgaaacacttgcccacgagtaaaaccgaacgccgtcgccgcctctatatgtcctttcggcactgccataaaagcaccacggaacgtttcggtaaaataagcaccgtagataaaaccgagagtgataataccagcgaccatcggatcgatatcaatctgcccgacgcccatcgcctccgtcaccgtgtttagcgcaatctgcaaaccgtagaaaatcagcagcatcaacactaagtccggcacgccacgaatcagcgtggtgtacccttcgaaaatcagccccgaaagccgattttgcgagagcttaccgccagcgccaattaaaccgatgattacagcgagcactacagagctgatagccagctccagcgtgacgagcgcaccctgtaaaataacacctgaaaacccatacaacatgctgcctgtcctgtcgtgtgtggtgaattaccgcctcttgtctccctccggttacccgaagggagcgggctttctttcaccgatggcgattagccaccataaacatcaaaatcgaagtactttttcgctaatttctcgtaagtaccgtcagcgcgcatttcggcaaaggctttgttcagtgcttcgcgcagttcgttatcttctttacgcaggcccatgccggtccctacgccaaacagtttttcatctttaacagacgggccaccgaatttgtaatctttaccgacaggttgtttgaggaaaccttcgctggcagcgacctcatcctggaacgcggcatcaatacgtccggcagtcaggtcagaataaatgttgtcctgcccctgatacgagacgatttcaatgccttttggtgcccaatgttcattaccgaacgtctcctgggtggtgccctgcaatacgcctacccgtttgcctttcagcgactcgactgtcggctgaatgtcagaatttttcgccaccaccaaacgagaatcggcagcgtacagtttgtcggtgaaggctatttcttgctgacgtttttccgtaatggaaagcgatgacatgatggcgtcaatcttcttcgcttttaaggacgggattaacgcatccagcggattttcgacaaacgtacattgcgtattgatgcgtttgcataattcctttgccagatcgatatcgaagccaaccagttcgccttgtgaattttttgattcaaatggcgcataggtcgggtcggtaccgatgcggatgttttgcggaatcgcagcaaacgccgcagttgcgctggagaaggccagaaccagagagagcgatagcaccagttttttcataatgtcctcaactgacagtctttttatagggaatatttacaggtttgttacacttatcgtgccataaaattgaccatcaaggcaaaatatcccgccccgttagacgtattatttttcattaaaaatgcttaagtatgcatttcaatgcaccacgatagtgcaacaaacctggcgtgcaccatgatgatcattccatcaggtacagcttcccagcgacgtatcagtcaccgtagacattaaagtcgaaatactttttcgccatcttgtcgtaggtgccgtcctgacgcagctcgccaagcgccttattgaaggcagccgtcagttcagcatcatctttacgtagccctacaccggtgccatcaccgaagtattttttgtcttttactgatgagccagcaaaggcgaaatctttaccagcaggttgcttgaggaatccttcgctggcagcaacttcatcttgtaacgcagcatccagacgtcctgcagccagatcggaatagaccaaatcctggttggcataggccaccacatccacgcctttactacgccaggtctcgttagcgtaagcttcctgggttgatccctgcagcacaccaacatgtttacctttcagtgaatccagcgttggctgaatcggtgaacctttggccgcaatcaaacgagaatctgcggcgtacagcttgtcggagaaggcaatctcctgctgacgtttatcggtaatggaaagcgacgaaataatagcgtcgatttttttcgctttcagtgaggggatcagcgcgtcaaagtcactggcaacccaggtacatttcacctgcatccgtttgcacatctcgttaccgagatcgatatcaaagccaacaaaatcacctttagcatctttcgatgagaacggtgcgtaggtggtatcggttccgatacgtaccgtctccggtagcgccgcatagctggaagccgctgtggagagaccgactaacaaagacagagcgagaatcgacttcttcatacataaccctcaagtgaaaatggcttttttatgttgtgtattgtgttgtgtgtttgcaggctctttcatgcaggtcttatgccatcttgacgacaacagtaacattcaacgttaaatatgttaataagacgttgcattattgtcctgaagttgaagatagcaggtatagcggttgaatcgcagcgtttcgattgaatggcagaaacaaaatgtcgaggatttgatcgcggttgcaaaattgccctgaaacagggcaacagcggagttatgcgccctgccagcgggcaaagagatcttcaggaagggttatcgcaaactggtcaagaacacgattaaccgtctgatttatcacatcatcaagggattgcgggcgatgataaaacgccggaacgggaggcataatcaccgcaccgatttctgccgcctgagtcattaaacgcagatggcctaagtgcaatggtgtttcacgcacgcagagcaccaacgggcgacgctctttcagcaccacatctgccgcacgggtcagtaagccatcagtatagctatggacaatgccggaaagggttttgattgaacagggtaaaatcaccatccccagcgtctggaaagaaccggaagagatgctggcggcaatatcgcgcgcatcgtgcgtgacatcggctaatgcctgcacttcgcgcagagaaaaatccgtttcgagggataaggtctggcgcgctgcctggctcatcaccagatgcgtttcgatatctgtgacatcgcgcagaacctgtaataagcgcacgccataaatcgcgccgctggcaccgctgatgcctacaatgagtcgtttcataaatagttgccctgtcagacttgcaggcagactttgcaggatttcggcgggagttgcaagtcagggtgccagaccggcaccctcagcgaaggcatcatccttcgttatgcatttcgagattttccacttcgttctgacgttgcactgctttggcgtcatcattacgtaacgtatcgaggaaatcgaggtagccctgatcaacatctttggtgacgtagacgccgttgaacaccgagcattcaaactgctggatatccggattttcagcgcgaacggcgtcgatcagatcgttcagatcctggaaaatcaacccgtcagcaccgatgatctggcgaatttcatcaacttcgcgaccgtgagcgatcagttccgtggcgctcggcatatcaataccataaacgttcgggaagcgaatttccggtgccgcagaagcgaggtacactttcttcgctccggcttcgcgtgccatctcgataatctgctcagaagtggtgccacggacgatggagtcgtcgaccagcaggacgtttttatcgcggaactcggcgcggttggcattcagtttacggcgcacggacttacgacgcagctgctggcccggcatgataaaggtgcggccaacatagcggtttttaacgaagccctggcggtacggtttgcccagaatacgagcaatttccagcgcgatatcacacgaggtttctgggatcgggatcaccacgtcgatatccagatcttcccattcgcgggcaattttctcgcccagtttcgtgcccatattcacacgcgcgctgtaaacggaaattttgtcgataaacgagtccgggcgggcaaagtatacatactcaaacaggcacggattgctgaccggattgtcagcacattgacgggtaaacaactgcccttcttcagtgatgtaaatcgcttcgcccggcgcgacgtcacgcaggaaatcaaagcccagcgtatcgagcgctacgctttcggaagcgaccatatattctgtacggttctcgtcaatatcacgttttcccagtaccagcggacgaatcccgtttggatcgcggaaagcaaccataccgtggccgataatcatcgccacacaggcatacgcgccgcggattaagcggtttgtggcagcaatggcagcgaaaatattgtcggcttccagcgggtagtggcggaagttgtccagctcgctggcgaagatattaagcagaatttccgagtcggaagtggtgttgatgtggcggcgtttttcttcaaacagttttttacgcaactcgtgagcgttggtcagattgccgttgtgggcaagcgtaatgccatacggggagttaacgtaaaacggctgcgcttcagaggcgctggagctgccagccgtggggtaacgcacatgaccaatgcccatattgccctgcaaacgctgcatatggcgagcttcaaatacatcgctcaccagcccgttcgctttacgcaaacggaagcagttattggcatctatggtgatgatgccggcggcatcctgaccgcgatgctgaagcaccgttaaggcatcataaatcgactggttaaccggcataacaccggcgataccgacaataccgcacatacgtctttttcctcgttaagccacatctcagagcacttacgctctgggcaagaaacttgacgagctttgcagataatcaaaaaaacatctgatgataaaactgaattgcgggatcagctgtgatttgctccagtcttcgcttttcgacaccccggtaaaggagtcgagaaagaagagaatggcagcaacaatcaacacaccgcgcaacgcaccgaaacagacgcccagcacccgatcggtgcctgacaaccccgttttctccaccaactggcctatcacgaagttcacgatagcaccaacgatcagggtagcgataaacagtaccgcgatggcaatcccatttcgaaccagttcgtcttcaaagcccgtaaaccagactgacaggtaagtgtagtaatgactggcaacaaagaaagcacaaccccatgtcaccagcgataacgcttcacgaacaaagccgcggatcaggctaaccagagaggaaaaagcaatcaccgcgattatggcgtaatcaatccagaccatatgtgtcccacgattttacgccctgtcatcctgttcggggcgcattctaacagaaaaagaaaacgtttgcgtagggatttccttcccgcgcatcaataaaaatggcgctgaaaaaatattcaacgccatcgactttttatgcctttgcggcatcgggcaatgcgtgtcggatgcggcgtaaacgccttatccgacctacggttctacccctgcgtaggcctgataagacgcgccagcgtcgcatcaggcaagaccgtattaattcggcgtatagcccattaccacgccacttaagccagaaagttgcttcaactcacccagcgaacctttcagcttatctttcgaggcatccggcccaaccagaatacgggtaattttaccctgcactggcgtggatggcgacgtataaacccgataaccggcaccgcgcagcttaccgacaatctcattcactttatcggcatttttcagcgcacccagttgcacaacataggctttacccgtcggtgcagctttttcttccacgaccggcttcggttctggcttcggcgcaggtggtgcttcaacctttggtttaggcggctccaccggtttcggcttcggtggggcgaccggtgcaggttccggttcaaactcggtgttattggctgcaatagtggccggatcgagcgacggtgctgcggcatcacctgcccgcacctcttccgctgcgccttccggcggctgcgtcggtaacgcctgggtggcggctggcatcatatcaggctcatcacgatcgcccgctttcggcaccagcgggatagccgcgaactcatcctgataatgttttttctgcccgtccagcagccctggaagtacaatcacccccagcgccaccagcacgatcgtgcccactaaccgattctgaaacttacttgccaccgcttctcctcgcgtcaatcacttccatgacatgtgcgaccgtgtggaaagaaccacacaccagcacggtgtcttccgctttagcgtccgccattgcggcatcccatgcctgcgcaacgctatcaaatgatttgccgttacccaaatgctcaagcagttgttctgccgtggcaccgcgcggcccttccagtggcgcacaataccagtcatcaaccacgcttttcaaccaggccagagttccggcaatatctttatcatgtagcataccgataaccgccagcacgcgcccgtttttcggtagcgctttcatacgcccggtgagatattccgccgcatgtggattatgcgcgacatcaaaaataacgcgtggcgactcgctcacaatctggaaacgtcccggcaaaattgcgctggcaatcccgtcgcgaatggcattttcactgacttccagcccgctggcacgcagtgccgccagcgctgttgcggcattcggttgcgggacaagcggcaacggcagattttccagcgtgccgtgagcatcgctaaacgcccagtcatgatcggtgacggaatagttccactcaacgccccgacgttgtaacagtgcacctttttcctgcgccacatcagcaatggtagaaggcatttccggctcaccgacaattgccggtttttcgctgcggaagatgcctgctttctcgcgaccaatactttcgcgatctggacccagccagtcggtatgatccagcgcaatactggttactaccgcgacatcggcgtcgacaatattggttgcgtccagacgaccgcccagccctacttccagaatcaccacgtcaagttgtgcctgcttgaacagccacaacgccgacagcgtaccgtactcgaaataggtcagggaaatatcaccgcgtgccgattcaatctccgcaaaagaggcggtgtgggccgattccggcaattcctggccctgcacacgtacgcgctcggtataacgcaccagatgaggcgaactgtagacgcccactttgtaccctgccgccatcagaatcgactccagcgtacggcaggtggtgcctttgccattcgtacccgcaacggtaaacacaaatggcgctggtttcaggacgccaagacgcgccgcgaccaggctcacgcgctcaaggccgagatcgatagttttactgtgcaggttttccagataagaaagccacgaagccagaggcgacgcggcttgaggagtgcgtttgataatcatggtatccgctgattcgttacggtgagaatagcaaaagggcagagccagtggccctgcccttatcagttatcaggcctcaggttcctgatccggtaccgggggtaccactacgccttcacgcggcgcttcaggattcggcgctggcagattcatcaacttcgccagaatgctcgccagtttcaggcgcatttccggacgacggacgatcatgtcgatcgcgcctttctcgatcaggaattcactgcgctggaatccaggcggcagtttttcgcgaacggtctgttcgataacacgcggaccggcaaagccgattaacgctttcggttcagcgatgttgagatcgcccagcatggcgaaacttgcagaaacaccgcccatcgtcgggtcggtcagcacggagatgtacggcaagccgcgctcctgcatttttgccagtgccgcagaggttttcgccatctgcatcagcgacatcagtgcttcctgcatacgtgcgccaccagaggcggagaagcagatcagcgggcagttatcttccagcgcctgctcaacggcacgcacgaaacgtgcacccacaacagaccccattgaaccgcccataaaggcgaactcgaatgccgcagcgacaaccggcattccatacagagtgcctttcatcaccaccagcgcatctttttcgccggtttctttctgcgcagatgccagacggtctttatacttcttggagtcacgaaacttcagcacatctttcggctcaagctcgctacccagctccacaaggcttccttcatctaacaggctatgcaggcgattacgcgctgtcatacgcatgtgatggtcacacttcggacagacctcaagattacgttccagctcagcgcggtataaaacctgaccgcagctatcacacttagtccacaccccttcaggaatgctcgccttgcgggtgggagtaatgttgcttttaattcgttcaatccagctcattagggacctttctgtctgaacctggttcgatgccagttttatctttggggacgcataatgccatttttgcccccaacagaccatgaatgttgcacattaaaacataacagcccgaaactttggataaaaaagtggtcgaaccgcggagttactttttattttgcggcgcgtgccgcagcgcgtttgtgacggattatttcgatgacgcccggcaaaatagaaaccacaataatcccgacgatcagcagcttaaggttatcctgaaccatcgggattgtaccgaagaaatagcctgcgtaggtaaaaagcagtacccacaacagtgcgccgatcacgttataagcggcgaaatgacggtacgacatgtggcccattcccgcaacaaacggggcgaacgttctgacgatcggcacaaaacgggcgagaataatcgttttgccgccatgtttctcataaaactgatgggttttgtcgagataactgcgacggaaaattttcgaattgggattactgaacaacttttcaccgaacaaccgcccgatagtgtaattgaccgcgtcacccacaatcgcggcgatcagcatcagcaccaccatcatatggacgttgagatcgttggtttccagtgatgccaacgctccggcaacaaacagcaatgaatcacccggtaaaaacggcgttaccaccagaccggtttcacagaacaaaattaagaacaaaatggcataaacccagacgccgtactccgcgaccagctctgccagatgcacgtcaatgtgcaggataaaatcgatgaggaaataaatcaggtccatatttgcctatgccttgtactcgtcatctttcaggctgtaactacgttggctacagcctgaaatgttccgagcattattctcgttagtccgccagaaatagcgggcccattggcggttttggaagatcataccggtcagggtaatccaccgcgaccagatacagcccttccgcttttgccgttgctgccgccagcgttctgtcctttgccgccagcaactctgctatccagctctccggctggttgtgggcaccgacttccatcaggctgccgacaatattcctgaccatatgatgtacaaaagcattcgctttaatatctaccaccacataaggaccgtgacgcgtgacattaatatgcataacgttgcgccacggggttcgggactggcactgcaccgcacggaacgaggtgaaatcattctcgcccagcaagcattgcgcagcccgatgcatccgttcagcgtccagcggttcgtaaaaatgggttacccctttactcagtaccgccgggcgcagccgatgattgtagatgatgtagcgataacggcgagccgtggcgctaaatcgggcatgaaaatcatcaggtacagttttaacccaacgcacagcgatgtcaccaggtaaattcgcatttacgcccaaggtccacgccgcgtctttgcgcagcgcggttgtttcgaaatgcacaacctgcccggtaccgtgtacccctgcgtcagtacgcccggcgcagaagacggtgatgggttcgttcgccacctgggagagcgccttttccagcttctcctgcacactgcggacttcgttctgccgttgccagccgtaatacttactgccgtcgtactcaatgcccagcgcaattttataaactggcggttgttgctggtcggacattagtacagatactcctgcaccagtttctcggcgatttttactgccatcagcgcgccgccaaagcgaacgttatcggccaccgaccagaactggacttgctccggcataccgtagtcattacgcacgcagccaacagaaagatgcggcgtacccgaagcatcacctacctgagttgggaattcgttctcttcagagagcacaatatcttcgccttgaacaaacgcatcacgcgcttcttctgctgccagtggacgcagagcttcaaagttgaccatctgggcatgaccgtagaataccggtgcctggacgacgctagccgaaatcatcagcccttcgtcctgcaggattttgcgtacttcgtcaacgatacgacgttcttcacgcacgctaccttcgctatccggcagtaacggcagcatgttgaacgccagctgacgcccgaagaaatcttcttcgtcaatcggaatgccgttgagcaatttcgcactctgccccgctaacgcatcgaccgcttttttgccctgggcggaggctgaaatcaggctggtaacgctgatacgtgataaaccgccctgatcgattaacggtttcagtgccgccagcagctggctggtcagactgtctggtacggcgatgacattccggttccggtaatctgtcagtacaaacgggtttacttccggcaccaccagcggtacgtcgggttcgagagcaaacaatccactgctgtcgatcaccaggcaacctgagttggtcgcttcttcaacccaggcagcggtagcttctttgcctgcgacaaaaaatgccagctgcgcctgcgtccagtcgaattcagcggcatcctgcacggtgattgtcttaccaccaaagcgcagttgttcgcctgcgctttcgttacgtgccagtgcataaatttccccaaccgggaactgacgttcagccagcgtttcaagcagggcttcgcccacagcgccagttgcgcccaggacggcaatgttccagccttcagacatggtggtttactccagaaatagcaaagctccctgccaatgttacagcagagagcatgaagaagagattaacgtgccggatgatgaacggcgttaaaacccagtttacacagcaatgatgccgcactggcgtcatcacaaattacatacagagatgaccattcacggcgctcaagatagtttttgcgcagtttatcgaactcacccggtatcccggcgactttacgcagcggtgcgtcatcgcggcgcacatcatacaccaaatgcaccagccttttcagcgtcggttgatcgagcgggccatgcagcgtaatgcgaccaaactctggcgcaggcagtaatgtatccagcgcaacgtgctgttcatgcccaataaacttgctataagcttcaaacacttgcgtagtaccgcgtgctttaccttccagggtatagcctgcgatatgcgacgtgccgatatccacttttttcagcagctcgacgttgagttccggttcgccttcccagacatccagcactacgcttaacttctggccttcattcaggcaggtcagcaacgcagtattatcgacgactgcgccacggcaggcgttaatcagaatcgctccgggcttcaggctacggatcagtttttcatccgccagatgtagcgttttgtacggaccatctttaaagagtggcgtatggaaagtcagaatatccgcgcgctggactaactcatccagcgagcggaaatcaccctcatccccacggtcggcgcgaggcggatcgcaaagtaaggttttaatccctaacgcttccagtcgcgcctgcaatcgacgtccaacgttaccaacgcccacgatccccaccgtacggtcgtacagtgaaaatccatcgcgttcggcaagcatcagcagggaggagaaaacatattccaccaccgcaatcgcattacagccaggtgcagcggaaaaaccaattcccgcctgcttcaaccatgcttcatcgacatggtcggtccccgcagtggcagtgccaacaaatttaatgggttttcctgccagcaaagattcattcactttcgtgaccgaacgcaccatcagcgcatccgcgtctgccagttgagcgacggggattggacgcccgggaaccgcggtcacctcacccaaacggctaaataagtcgcgggcataaggcatattttcatcaacaaggattttcacgtttgtgttacctgtatgagacgagagttaaccggacaagtgtgccataatctcgcggccaggcatacttgcgaagatttcaggtataaggatacgtaatgatacaacctatttccggccctcctcctgggcaaccaccaggtcagggagataatctgccgtctggcacgggcaatcagcctttatccagtcagcaacgtacttcgctggaaagcttaatgacgaaagtgacctcactgacgcaacagcaaagagcagaactgtgggcgggtatcaggcacgatattggtctgtcgggagattcaccgctgctttcgcgtcacttccctgccgctgagcataatctggcgcaacgtctgctggccgcgcaaaaaagccattctgcccgccagcttttagcgcaattaggggagtatttacgtctggggaataatcgtcaggcggtcacggattatatccgtcataactttggtcagacgccgctgaatcagctctcaccggagcaattaaaaaccattctcaccctgttgcaggaagggaagatggttattccgcaaccacagcagcgcgaggcgaccgaccgtcctttattaccggcggagcacaatgcgctaaaacagctggtgaccaaacttgcggcggcaacgggggaacccagcaaacagatctggcaatcgatgctggaactttccggggtgaaagatggcgagttaattccagcgaaactgtttaaccatctggtgacctggctacaggcgcgtcagacgctaagccagcaaaatacgccgacgctggaatcactacagatgacgctaaaacaacctttagatgccagtgaactggcggcgttatcggcatatatccagcaaaaatatggtctttctgcgcaatcatcgctttcttctgcccaggccgaggatattcttaatcagctttatcaacggcgggttaaagggattgatccgcgtgttatgcaaccgctgcttaatccttttccaccgatgatggacacgttgcaaaatatggcaacgcgtcccgcgctgtggatactgttagtcgcgattatcctgatgctggtctggctggttcgttaaccccgacgaaatgacagtatcgtgacaataatacccagcaccgcagagatcgccccggcaagaaataccgaagagtaaccaaacgtggtcgccagcattcccgccagcggcccggagacgccgagggcgatatcctgaaacgcggcgtaaccgcccagtgcggtgccgcgaacttgtgaggggacgcgtttaaccacctccacgcccagcgcaggaaagataagcgaacatccggctccggttaacgccgcgcccgctaatgcgacccatgcacctggggcttgccagagcagcaacaagcccaccgtttctacaagcagagagacaatcgccactttcacgccgccaaaacggtccggcatccagccaaacatgacgcgcatcacgacaaatgcgccgccaaacgcggtaagagtaaagcccgccatcgcccatcctttgctggcaaagtagagcgaaacgaaagtcccgataacagcaaaaccaacgccttgtagtgccagacctaaccctggtttccagataagcccgacaacgctccacagcgatggacgttctcccgccagggccggtactttgcgcactgtgccgttacaggcccacgccagtacgggtaataccattgtggtgatcgccagtgcggcaaaaccgtaatggctatgaatcaacaggccaagcggagcaccaacagcgagggcaccgtaaatcgccattccgttccatgacatcactttgccagagtgttttggccctacgatgcctagtccccaggtcagagcgcctgtcagtaactggctttcaccaaagccaagaatcaaacgcccgacgaccaacagagcaaatttgaacggtgcggagacaggcaaaatcgccgccagcagcaacgcgccgccagccagaccacaagctaacattccctgaagcgccgaacgttttgcaccatattgatcggccagtcgcccggcgtaaccacgcgtcagcaccgtagccagaaactgaatcccgacggcaatgccgaccatggtattgccatagcccagttcatgatgaacaaacagcgggataaccggcaacggcaaccctacggtcatgtaggtgagaaaaaccgcaaaagcgatgcggaagagcgaaaaattggcagaagatcgtgtttcggtttggcttacagcagtcatgcattactccagaatgcagcgcaaggcgaggagtatccccgtctcatctctctggtttcagggttacggtgcgttggcaggatttaacgcgtacgtcttttcagaaggaaatcgacaaagcgggaagtttgcctggaactggcggcgattgtcaatgatgtgaaaaagggaaccatcaggttcccttttgcgttagtgccggaggccgcattggcgcgtaacgtcggatgcgacgctggcgcgtctactccgacctactgcgaattaatctttcagcttgcgcattaccagcgtggcgttggtgccgccgaagccgaagctgttagacataacggtggtcagttcgcgatcggtcgtttcggtcacgatgttcagacccgcagcctgctcgtccagctcttcaatgttgatgctcggggcgataaagccgtgttccagcatcagcagagagtagatagcttcctgtacgccagcagcgcccagagagtgaccggtcatggctttggttgcagaaatcgccgggctcttatcgccgaacacttcacggatagctgccagctctttcacgtcgccaaccggagtcgaagtaccgtgggagttcaggtaatcgattggggtatcaacgccatgcatcgccatcttcatgcagcgtactgcgccttcgccagacggagcaaccatgtctgcaccatcagaggttgcgccgtagccaacgatttcagcatagatgtgagcaccacgcgccagcgcgtgttccagctcttcaaccactaccataccgccgccgccagcgataacgaaaccgtcacggtgagcgtcgtaagtacgggaggctttttccggggtgtcgttgtatttagtagacagcgcacccattgcgtcgaattcgcaagccatttcccagcacagctcttcgccgccgccagcaaacacgatgtcctgtttgcccagttggatctgctctactgcgttaccgatacagtgtgcggaagtcgcacacgcggagctgatggagtagttaacgccatgaattttaaacggggtggcgaggcaggcagaaacgccggatgccatcgctttggtgaccacatacgggccaaccgctttcaggccgcgcgggccgcgcattgcgtcagcgccgaacacctggaaacgcggggagccgccgccggaacctgcaatcaggccaacgcgcgggttattctggtaagcttccggagagaggcccgcatcagcgattgcctgctccatagaaaggaatgcataaatggatgcgtcgctcataaagcgcacaactttgcggtcaatgaggccagtggtatccagttttacgttgccccagacgtggctacgcatgccggaatccttcagctcctgagagaaagtgatccctgaacgtccttcacgcagagatgccaggacttcctgctggttattaccgatgctggaaacaatgcccaggccagtaatcactgcacgtttcattcaatacctctgtaagtcgcacatagagtaagtttcgaatgcacaatagcgtacacttgtacgccgaacaagtccgatcagccatttaatagagaaatttgcgcagccttacacacatcgctaagatcgagccaccgcctgtaagacgagtaacttacgtgaaacactactccatacaacctgccaacctcgaatttaatgctgagggtacacctgtttcccgagattttgacgatgtctatttttccaacgataacgggctggaagagacgcgttatgtttttctgggaggcaaccaattagaggtacgctttcctgagcatccacatcctctgtttgtggtagcagagagcggcttcggcaccggattaaacttcctgacgctatggcaggcatttgatcagtttcgcgaagcgcatccgcaagcgcaattacaacgcttacatttcattagttttgagaaatttcccctcacccgtgcggatttagccttagcgcatcaacactggccggaactggctccgtgggcagaacaacttcaggcgcagtggccaatgcccttgcccggttgccatcgtttattgctcgatgaaggccgcgtgacgctggatttatggtttggcgatattaacgaactgaccagccaactggacgattcgctaaatcaaaaagtagatgcctggtttctggacggctttgcgccagcgaaaaacccggatatgtggacgcaaaatctgtttaacgccatggcaaggttggcgcgtccgggcggcacgctggcgacatttacgtctgccggttttgtccgccgcggtttgcaggacgccggattcacgatgcaaaaacgtaagggctttgggcgcaaacgggaaatgctttgcggggtgatggaacagacattaccgctcccctgctccgcgccgtggtttaaccgcacgggcagcagcaaacgggaagcggcgattatcggcggtggtattgccagcgcgttgttgtcgctggcgctattacggcgcggctggcaggtaacgctttattgcgcggatgaggcccccgcactgggtgcttccggcaatcgccagggggcgctgtatccgttattaagcaaacacgatgaggcgctaaaccgctttttctctaatgcgtttacttttgctcgtcggttttacgaccaattacccgttaaatttgatcatgactggtgcggcgtcacgcagttaggctgggatgagaaaagccagcataaaatcgcacagatgttgtcaatggatttacccgcagaactggctgtagccgttgaggcaaatgcggttgaacaaattacgggcgttgcgacaaattgcagcggcattacttatccgcaaggtggttggctgtgcccagcagaactgacccgtaatgtgctggaactggcgcaacagcagggtttgcagatttattatcaatatcagttacagaatttatcccgtaaggatgactgttggttgttgaattttgcaggagatcagcaagcaacacacagcgtagtggtactggcgaacgggcatcaaatcagccgattcagccaaacgtcgactctcccggtgtattcggttgccgggcaggtcagccatattccgacaacgccggaattggcagagctgaagcaggtgctgtgctatgacggttatctcacgccacaaaatccggcgaatcaacatcattgtattggtgccagttatcatcgcggcagcgaagatacggcgtacagtgaggacgatcagcagcagaatcgccagcggttgattgattgtttcccgcaggcacagtgggcaaaagaggttgatgtcagtgataaagaggcgcgctgcggtgtgcgttgtgccacccgcgatcatctgccaatggtaggcaatgttcccgattatgaggcaacactcgtggaatatgcgtcgttggcggagcagaaagatgaggcggtaagcgcgccggtttttgacgatctctttatgtttgcggctttaggttctcgcggtttgtgttctgccccgctgtgtgccgagattctggcggcgcagatgagcgacgaaccgattccgatggatgccagtacgctggcggcgttaaacccgaatcggttatgggtgcggaaattgttgaagggtaaagcggttaaggcggggtaatctgctctcgcagtgtttgccggatgcggcgtgaacgccttatccgacctacgtgtgacgtgtaggcctgataagacgcgataagcgtcgcatcaggcatgctgctccagacgccgcaacttactgctgtgacgcctgctgaaacaggttttcccacatatcggtcaccagcgcctggtcacgcggcgacaattcaccagcaccaatggctttttccagactctggctaacggtcgtatgcaccgcctgagcggagtggtcatcaccactttccagttctgcgatggctaatgtcaggtggccacgcaaatacccactggcaaacaactcatcatcactggcatggtcaaccataccgtcgattaatgccagaatgcgtgattcaaactccgcgatcatcttctttcctcattgtaaaacgtggcgctggcttcagttgagcgcttccggccacgggaactgttccgccgtaagttccggcgtgtgataataattttgtagtgctttaatgaagcgtgccggacgttccggaatgccatttgtcagataatccatcacctgcgcatgtactcgccgttgaaacaccacacgatccggttcgaaatccccttccagattgtcgcaactgacgttaaacggatatcccgccgccacacagaacaaccagtcgagcgcctgcggcttcacttcaacatcttcaaactggctttgcgtttgggcatcgcgtccgtccgggcaataccagtagccgaaatcaaccagctcacggcgcgctttcccggcaatacaccagtgcgaaatctcatgaattgcgctggcataaaagccatgagcaaagacgattcggttatacggtacttccgcatcagcaggaagatagatcggttcgtcgtcgcctttaatcagacgggtattaaaatcatcggcaaagcagctattaaaaatttcaatcaactgctcgtagtggtgtgtactgttcattagttcatccccaaccagtggaggatctcctgtccgtggctgtcgtaaagtaatttggcactcatcaccgccgagacgataacaatcatcgggcggatcagcttttgtcctttgctcaacaccagtcgtgaacccatgcgcgcgccgaggaactgccccaccagcatgacaaagcccgtcgcccaaatcactttgccgccgagaataaacagcagtaaaccgccgatgtttgacgttgcgttgagtaatttggcgtgagccgtggctttggcgaggttaaatccgcacagcgtaacgaaggccagcgcgtaaaacgacccggcagccgggccaaagaatccatcataaaaaccgacgcagccaccggctattaacgcgaagggtaaaccgtacatccggcgctggcggtcttcttcacctagctttggcatcagcaagaaatagaggccgatacaaattaccagaatgggcaaaatctgccgtaagacatcagcctgaacgtattgcaccagcagtgcgccgctcattgagccgacaaaggtcatggcgatattgagtttctgatcgcttaaactaaccactttgcggcgaataaagtagatagtagcggaaatagagccgccgcaggcttgcagtttattggttgccagcgcattagcgggagacatccccgctgccatcaatgccggaatggtgagtaacccaccgccaccggcaatcgagtcgataaatcccgccagcatggcgacaaaaaagagaactcccagcaacagcggggaaaccataaacaggctattaaacgtttccattagatcacgtgctcatccagtagcgcctggcaggaaggcggcaacggaggcggtgtcttcttctcaggctttgttgttcccggttttggaggttcaaaccagctttgcagttctgccccgcaaccatcgcctgatggcggtaaaggttgatcttcacactccagactatcggcagggcaacgtaatcgtacatgcatatgcgcgcgatgctggaaccagggtcgcactttgcgcaaccagtcgcgatcggtgcccgcatcaaggcaaagttgttgtttaatcgccggattaacaaaaatgcgcgtgacgtctttgtcctgggcggcgagtttgatcaagctgaaaatttctggcttccacagcgtggagacaacgtgtttaccgtcgcgggaaactaagtccagtgcttgcgggcgcaagagctgcgcggaggtccagcgagttttcggcagttgcagaaagatatcgacatccagtccggtctggtggctggcatgaccgccgttgaaacgcccaccagcgggcatccccatatcgccaatcagcaccgtacccatgcccagattgctcacctggctactcagacgctggataaacatcaccagatccgggtgaccgaaatagcgacgctgatcggtacgcatgacctgataatgttcggactgtatcggcagcgtgtcagcgccgacaatacagccattagaaaaactgcctatcgattgtgcgctacccggcacaggttgggttattttttgccacggcgtcgctgccaggctggcgctactggcaagcagagccagcagcgcaatcgcggttttattcattttttaccagcgtggaatatcagtcttcacatcggcattttgcgcccgttgccgtaacaggtgatccattaaaacgatcgccagcatcgcttctgcgatcggcactgcgcggatcccgacacagggatcgtgacggcctttggtgatcatctcaacttcttcgccaaagcggttaatggtacgacccggcacggtaatgctggaggtcggtttcagcgccatatgggcaatgatttgctgcccgctgctgataccgccgagaatgccgcccgcatggttgctctggaaaccgtctttggtgatttcatcgcggttctggctgccgcgcagcgccaccacgtcaaagccgtcgccaatttccacgcctttcaccgcgttgatgctcatcagcgcatgggcgatgtcagcatccaggcggtcaaagaccggctcgccaagtccggcaggaacgccactggcaacaacggtgactttagcgccgatggagtcgccctcttttttcagcgcacgcatcaactcgtctaacgcgtcgattttgtcggggtccgggcaaaaaaacggattttgctcgacctgcgaccagtctttgatatccagcggaatgtcgcccatctgggtcaggcagccacggatttcaataccaaatttctcggcgagatattttttggcaatagctcctgccgccacgcgcatggcggtttcgcgggcggaagaacgtccaccgccgcgataatcgcgcagaccgtatttttgttcgtaggtgtaatcggcatggcctggacggaaaacgtccttaatcgcactgtaatcctgagagcgctggtcagtgttttcgatcaacaagccaatgctggtgccggtagtaacgccttcaaaaacaccggagagaattttgacctgatccggctcgcggcgctgggtggtatagcgcgatgtcccagggcgacgacggtcgaggtcatgttgcaggtccgcttccgtcagcggaatgcctggcggaacaccatcgacgatgcagccgagcgccagcccgtgcgattcgccgaaggtggttacgcgaaagagttgtccaattgtgtttccagccatcacggctccgttattgttgtgtttgcgtgtttacttaatctttataaatcgcgaaatgttctcgtgcggcaataagctgctctttggtgagcataaacacaccatcgccgccgttatcaaactccagccaggtgaacggaacatccggatattgttccataagatgtaccatgctgttgccgacttcacaaatcaacacgccatcatcagcaaggtaatctgccgcgttaccgagaatgcgacgcgtcagtttcaggccgtcagtgccagatgccaggcccagttccggctcgtggcggtattcgtttggcaggtcggacatatcttccgcatcgacatacggcgggttagtgacaatcaggtcgtactgcactttcggcaagtcgcggaacagatcggaacgaatcggaatgacgttgtggatcagaccgtgttcttcgatgttctgttcagcaaccgccagcgcgtctggagagatatccaccgcgtcgacttctgcatccgggaaggcataagcacaggcaatggcgatgcagccgctaccagtacacatatctaaaatatgctgcggttgcttgctgataagtccggcaaatttattgttgatcagttcaccaatcggcgagcgcggcaccagcacgcgttcatcgacgtaaaattcatggccgcagaaccacgctttgttggtcaggtaagccaccggaatgcgttcattgacgcggcggatcacgcgttcaacaatacggtgtttttcgctggaggtcagacgcgcggtgcgcatatcttccggaatatccagcggcaggtagagcgaaggcaacaccagctgtacggcttcatcccacgggttatcggtaccgtgaccgtaccagatatttgccgcgctgaagcggctcaccgaccagcgcaacatgtcctgaatggtttgcagctcatttactgcttcatcaacgaaaattttatccacgtattcctccagggcatgatcgcaataatttcggcggctagtttgccatgaagatgacgataaatcagcattcacgcgcggtgagtgaggaaaaatacgtttaaaacgatcgattgcgctacgagtcgggtaaactgtaggaaaattagaaatagagacagataaatgaaaaagaaaacaacacttagcgaggaggaccaggctctgtttcgccagttgatggcggggactcgcaagattaagcaggacacgattgtccaccgaccgcagcgtaaaaaaatcagcgaagtgccggtgaaacgcttgatccaggagcaggctgatgccagccattatttctccgatgagtttcagccgttattaaataccgaaggtccggtgaaatatgttcgcccggatgtcagccattttgaggcgaagaaactgcgccgtggcgattattcgccggagttgtttttggatttacacggtctgacgcagctgcaggccaagcaggaactgggggcgttgattgccgcctgccgccgtgaacatgtgttttgcgcctgcgtgatgcatgggcacgggaagcatattttgaagcaacaaacaccgctgtggctggcacaacatccgcatgtgatggcctttcatcaggcaccaaaagagtatggcggtgatgcggcgttgttggtgttgattgaagtcgaagagtggctgccgccggagttgccctgaggagttgagcgcgttgcgccaggtacgggtaatggcaggggcgaatgcccctgcctggtgtatctaagggctacaactcattcagtatgtactggaaccggcaagtagaatcgattggctgcatactgctggtatcaacacgcacgaccatatcgtgtaactgtttgtccgttatagggtgtcgatttggcgtgaccgagacttccgccttgtcacatcccgacgcggtaaaagttatcatctgtgcaacccagcggcagtaaccacctgtttcattcatctgcgtactgtcgcacaacttcccatctttcatcaaatacgttgaaagcgttttctcaaccacaccgcccgtcgactgcagggtgagcagttttgacttactgacataattctcattccatgaaacgtcataaggttgaacagaaacggatggacaaatcgtgtcgtgactatcaggcccctgatacgtcacgccccctggagaggcttcagagtcattcataataaccaaccatggacaagaaaagtaagattcaatctctgcagagacaataacctcaaatgtataatacccgcagttccacccagacggtaatccaggacaacttgctttgttgatattttgatggtagccaatcagcttaaccgaaggggcaggaggaggaccactccagctcacattttgcaatatttccccagtcatgagccattgactacttttatattcaccaacgtacactgcggatggcatcattatttttaaattaaaagtcgcaatattacgcgaatcaccgttgtaaccgtagtaaacgtcaacgctatgcccggcagccatagcttctgtagtagcaataagcatgaccagagcgaacaaccatcgtagtattttcattttaaatatactcaaatgtcgcagttaaagaggcggtaaattcaccgatcgtcacatcacggccgcttttcgcctgtagccaggctctgaaattgatatcgttattgccattggttagcgcaaaggtcgccccatttgtattgttgatggcaacctgcattccgtcggttttttccatgccaattcccactccctgagcggttgatgacgtatccagtgccagaaaaccgggttgttcgctgtcttctacccccgtgagcgtgacttttacgttgtatcccgccggccctttgcaatctttcagcttaaagactacgggtacacgagcggactggcctgcaacgttcaaatcctgacgactgaccgtgggaaagcgcacctctgccagatattggccatccaccaccagcgcacaggatttacttaataaattaccggagaaatgcagattattatctgccgcgaataacgtgctactcattgccaatatcagccccgctaacaggacgtaaccaccggactgaatcattgatttattcattgataatccacccgtaatgttgcgtaagccgaaaaattcgtatcgcttaacacagcatcactcgcttttaccggtacggcctccagcttcggcttttgcgtaaaatcagtggcgttgatagcaagcggagtattgagtttaaaacgctgaccatcgtgctgaagctcgataccaaaaccgggtacatcagtttcaattgctgcatcattaaaactggtttgtgtaccagtccaggtgagggtcatctcccaatctggatgacgggtcgtcgagtcacaagtgagttcatatggcacctctttacgaccatagttgccgttgatgtcgtcgataatgagatcgcgaaattcgacttcaatggttttaccaccgctgatgctacaggttggcggtgacaataatgtcccgtgaaaggtgatgtcttcatcagcagcatgagctatggcgctactgacacaaagcagggttaagaaagtctttctcattgatagtccaccaccatggtcaaactggcgttaaactcgcccgcagcaagttgcgccccgcttgccttcacaggtacagccttcaactgtggctggttattgatattaaatggcgtccagctattttcaccgacggcaaacaatgagttatcggcgctattttctatccgaatgcccagcccggtgatattggtactgagtaccgtttcgccgttaatcgttgaggtattgcccttaagttgcatccgcaagtcgttagcaagactgtttgtgcagttcaacgtgtatttcgcatcttgccgataattggtgccatcaacgttatcagcaatcatattgccgaactctacctggctgcccttgattgaacagggtggcggagcatcgaccaacacgcgcagaattaaatccacgggtttactaccagccatagcagataaactacagacactgcataccagcagccctgcgcccactacaaacttttgactcataactccccccgtcatcagcctttgcggctctgctcttcatccacctggcagctgttgccattgcactggaagaacagcggcatccgtgcgccaaagtcgttgacgtaagtcagcaccggtacgctatccattttcacattcagcggtaccgtggttttcggctcaatgaccagaggcgagaaccctgcagctggattaccgtttttctgcgcactggcgttgctgataatcacgtagtacggcgttgggttattgacggtaaatgcctgaccgctgcgggtgagcgtcaccttgtgctgccacggacttttcatactgaccttttccagcgcctttggtcgccagaacaacttgatacgcgtttgcagcgcgatttgcagggtattgggtttgtttgattttggcgggatctcgcgcacgttaaagtagaacatgctttcacgatcggctggcaatttgttgatatccggcattccctgcacttttacctgcccgttcatcattgaatcgatgcgttgcactggcggcagcacagttaacggcgaggtgatcttgttacccttttcatcttcaatccagctttgagccagataagggagtttcggatcgttattacgcagcgtcacgctgattgatttgtcgctttcattaaatatcaaacgggtacgatctggcgttacagacgccagggcagacaaactggtagcgctaagcagtaacgccagcgtcatagcacccaatttggcagagcaaagtaaatcagacatggatcattccttaatcacgttattggttagctgaaacagaaacagggggatcggtgggtgtcacctgttgcgtctgctcctgaatgacaggctttatgtcatcaggaacaaccggcgcgacgttgcctttatgctggcatggcagtaacaagccgttaaacagatcggcaggcagcgggtccggcaggttgatatcgcaatgcgcaacaccactccagaacacactcatatgttcgccaggtttcaccccagccagatagacactaccgtcatcatcgacaaggcccactgtctgctcgttatcattttttacttctgcgccaaacggtggatggctgccatcttgtaaacgcagcaccgccatcgctttttgaccactgatgacggcaaatttgcggtagccaatggctccttcagttagcgtggcttgcaccaccgactgggttgcttcggcgttttccggcaatttgttgaggtcgatatacgcctgattgcgataataattgttaacgtcagaaacgacggctttaccaaacatattggtataaacagcagccccgttaccttccaccggaacatcggcaacgccatcggcatcaatcagcaggcgtgtcccgcccatattctgggtacggtgaagtgcgccgccgtgggtagtaagcgttgcgccgccctgtaacgacaagcccgcagaggtgtattgcccttcatggtagttcgcactgaggtcaacctgcgccagcgaaccatcatggctgtagtagccatcaacgctggtgtgtttgtcactggtgccgatgttcaactgatagtgagtcgcgtcatcgacacggctaaaataaccgacctggctgctgtccgtcccactgccatagttgccgttatagctaacggtactgttgtcgccccacggcatactgagcgaaatctacatgcccttatccgcccggttgtcatactcgtagcggtagccagtcagggaaacgctcatattacgaatgctgcccatattgaaatagtgggagagcatgatgttgtagtttgtctgctcctcacgatcccagtaggtatggcgggtatagttgagataaaccgaaacacccgcatcgcggaagttctggttataagtggcggtgtacatctctttgtcgttgcccgtacggaccatttcgctgtcactggcatccagatactcgctcatggtcataaagttctcttccgagaagcgatatccagcgaaagtgacgcggctgttgagctggtcaaagtctttggaataactcacacggaaggagttaccgtccagcgaacctttgccataagcggtgtctttatccagtttggtatgcgaatgagtaacatcaaacgcgaccgcgccgaaggtagacaaatcgcgaccgacgcccagcgccgcagactgatagttttcatcacccagcgcaccgccatataacgaccagccgttagcgatgccccaggaggcttcagcaccagagaaaaatcccccctcgacatggtggccccactcttgcggacgtcccatcatgatcttatagcgaacctggcctgggcgagtgaggtatggcatcgaggcggtgctgatgtcatattcctgcacctggccgttctgttcttcaatgcgaatatgcaacgtaccggagacggaatcaccaagatcctgaatacgaaacggtccagccggaacctgcgtttcgtaaatcacacgccccatctggctgacggtcacttttgctgtggtgtgtgccacgccggaaatgtctggcgcgtagccgcgcagattgggaggcaacatttgatcgtcagtgctgacactgccaccaacataattaaaaccgtcgaaaatatcggaattgaggtaatcttcgcccagcgccagtttggcttttaatgacggtaacgcccgccaggcataatagcgactccactcccattttttttgtgtgtcatcgccgccaaattcatcgtcatcatcattactgcgcgtatgttgatagttggtctgccagtcagcgcgcatacgccatggccccaggttaaccccgaccgtcccgttgccgctgatctcgttactgtcatcgccgccattttcttcgtgtcgtgtttgcgcagtgatgctgtagtccgcaatgatcccggagatgccatcatcccaacgagaaggtggatcccagtcgggccaggtatattcgaggtaagcctgcggtagtgaaatgactaatgcggactggcttaaatcagccttaatttccacgccttccagttgaccgggcttcaggcatttaccatcgtggctccattgcagatttttcgccacgtcttcttttaaaccaaactgcgccaccagttccggtgtcagacaagcatagcttttgctaacgtcatcttcaccagcataccagtaaatatcgtactcttccgccaatggctgtttatttagttgaacctgtaaattgtattttccgggctcaacatacccctggctggaaaaacgcttcagatcaatttttgtgtcgccttttaattccagaaaacgggaatcaaactgaatgtcgtcttcagcccagacactgctataactccctgacattgccagcgcaatgcaccacggaagaatccgtaatcgaaaaagagaatggtcaggcatacacgtttttatccgtttttattcttgttcggtcaaaatccatttaaataccccatagcagtgtcgctatgggggtatgccttacaggtaagtaatctggaaggtggtatttgcttcgaaattacccagatctggcgcatcagctgcgccgaccagccaggctttaaagttcagagtctgcttcgctttgcctttattagtggcagtatctttcacgattttctggtcaatacccatgccgcttttgtaagaggtacccagagagtcaccgatcgccaggctaacattgttaaatgccgcaccggtatcggtattgaaaatggtgtaataattgccgctatttgcagaagaaacggtaccagtaaaggtagtggtcattgtttcctgagtatcaaatacgcaatcttgcaggcgaatctggaaatttttcggcgtggtggtgccgttatttttcagtttttcggcaccgatatcacccatatcaacttccagtttgtgatcgtccggaacgatagaacacactgagtcttcaatggtgccgtaaaaacgtgcagtaccgttgttacccgcagcgattgttgccgtagaggtgaacgcgcccatcaccattgccgcagcaatagctgttttaacaaacttactcattatttgtccttaaactataaataattaaaatataaacattgcaatacattgattcagtcaatagccaatgtttatacccagccattgaatacggcatgcgatccaaaaaaacaggtcgtaaaaaatgtattcgttggtgtggggtcgaatagtgatgttttcactcccctgattcaatttaattttactaatgagtaaatgtagatttaattaatatattgataggggaaagattatcttaaggatcttctaaaaaaacacgaaatatatatttagaaaaaacaggaagcatatcaacaatgaatgccaatagcttaaaaaacaaacaatgaacatataatgcgattggcattaacccgcttttgtcgatataatatataaacactatagccagaatttaatcaagtttcaattacgtcctgcctgattattcaactctattttctccattatctgtattaataaatgataatgagtgtcaaacagacattattcatttcaacatgtaactttgggcaaaatcaagatacgcgcagaagaatactttccgaatgaaagttaaaggtgttttatttatagatggggagagtcttcgatagtagtgaggttgacagatatccgctgcctgatgagcaattatgcccaatgaatctacctcattgggcataatttggaactcatcagatagcttttgccatcttcagattacacgggctcatctgccagttgaatgtgccgtttccgctttcatcaagcgttacgctggcaatggccgaggtggtaaacataggcggcgtttcgcccggacataactcggcaaccagatacccgactaacggtaagtgagagatcaccagtaccgaagcaacaccttcattggtcaacgcctgcaaataggcactgaccagaccaacatcgccgcagggcgttaactccggcagaacttctgcactggaaggcaggttcagacaatcccctacttcttccagtgtttgctcggctcgcaggaacgggctcaccagaacgcgttcgatttccactttttgacctttcagccagttcgccatcaggcgagattcgtcacaaccattagtggtcagaggacgaacggaatcactggcggcatcgagggctgcgtcgccgtgacgcatgataaaaacttgcatattgcaccgcttttgttaaccagattcgcccgttttctttcatctgaaaccagagaaagaaaacggtggccggcattgtgccttatccattcaccgaatgaaacgctgttttttacctcaatggcgtaagtatagtcaatatgcgtttacattttgaccaacactccgccattcagcgcggattcatatagctttgaccttcttattgcaggtcagttgcagttgttttccaaaaactttccccacgcgcgcccatctcgaccaaacgctcgcaaggggtaaaacgggaaccatactgcgtggcaagtcgttgcattattgcaaccacttcgcccgcgccgagagaatcgatatagcggaacggtccaccgagaaatggcggaaaaccaatgccaaataccgcgccaatatccccgtcacgcacgctacggataacctgctcatcaacacaacgtactgcttcattcagcatcaacatcacacaccgttcagcaacctgcggtgcggagattcgcccctgcccttgtgtgccaatcagcgggtaaatggcgggatcgacctgttttttgcttttacgccctttctgaccataaagatagaaaccccggccattttttctgcctttgcgatcgtcgttcaaaattgaagaaacaacatttgcaggcgcgctaaaacgttctccataagcggcttccagtacaggaataattttagtcccggtgtcgattcctacctcatccaaaagttggattgggcctaccggaaaaccaaatttcactagcgcggcatcaatgtgctctacccgttcaccttgggtcaacatgcggatagcttcattaatgtaaggcgctaagatgcgattgacgtaaaaaccggctttgtcacgcacgacaattggcgttttaccctgttttttcgccagttttactgtggtagcgatggtttgcgccgatgtccccgcatgaggaataatctccaccagcggcattttttccaccggactgaagaaatgcaggccgataacttgctcaggtcgcgtggcgtgagcggcgatatcaccaatcggtaaagatgacgtattcgaagcaaagatggtatgagcggcgcaattttgctcaacttccgccaccatctgttgtttcaattcgagattttcaaacaccgcttcaataatcagatcgcgatgggcaaagccgcgatagtccgtcgttccggagattaatgccagctgtttgtcacgttcgctggctttgagatgacgacggcgaactttgccctccagctgatcccaactgtacttcagcgcatgatttatgccctgcgggttgatatctttaattctgaccggaatccccgctttacaagcagtgacataagcaataccgccgcccatcaagccaccacctaaaatccccacgctgtttaatggcgcaggcggcgcatcactgccgggatctttcttcacgtccgtactggcaaaaaagatactacgcagcgcctgcgattgtggcgtcatcgccagttcgccaaacgcccgagcttcggcgtcataaccgctgctggtgccctgcgctaatcccgtttcaacaacctccaggatgcgttctgtcgccggataattgccttgagttttgtgttctgttttcttgccgaccattttgaacagcagcgcacgacctaacggccccgccagaatacgctcgcgtacaggtagagggcgggaagatgggcgctccttctttgccagctcaacagcggcttccagcagaatggagtgcggaacaacgtcatccaccagccccagctttaatgcctgtttcgcccgaagttgttttccggtgaggatcatctctaatgctgtgctgacgcctatcagacgcggtaaacgctgggtgccgcctgaaccgggtaacaatccaagttgtacttcaggcaaaccgagcaccgttttaggatcgtcagtacaaacgcgaccgtggcacgccagcgccaactccagcccaccacccaggcaagcgccatgaatagccgcgataacctgaatgggcaaagcatgaatctccgccatcaactgttggccctgccgcgccagagcttccgcttcttgcgccgttttgcagttgccgatcatgttgatgtctgcgccagcaatgaagttgtccggtttagcggagacaaacaccacgcctcgcaactctttgttttcacggagttgcttaataatggcgcgcacctgcgaggcaaactccgccttcagggtattcattttctcacccggtacgtcgatggtgataacggcaatgttgtccagacgaacattaagggtaaacgctgatgtcatttccattattccgcctccagaaccattgccgcgccaagcccaccggcagcacaggcggtaactaaaccaaatccaccgccgcgacggcgaagttcatgcaatgtctgggtaatcatccgcgcgccggtcgccgcgaagggatgcccgtaagcaatcgaaccgccaagcacgttaaatttgctatcgtccacttcgccagtggcatgtgcacgccccagtgcttcacgagcaaaacgttcactacccagcaactgaatattcgccagcgtctgagctgcaaaggcttcgtgcatatcgatcaatgtcagatcgctcatcgtcaaaccggcacgctccagcgccagcggtgttgaccaggctggaccgagcaacatgtcctgccagacatcaatcgcagtaaatgcgtagctgcgcagataccccagcggcaccagccctaattctttcgcccgggattcagtcatcaggatcaccgctgccgcgccatcggtcagcggcgtactgtttgccgccgttaccgttccgtgtttgcgatcaaacgccgggcgcagctttgcgtaatcggcaagcgaggaattaccgcgaatattgttgtcttcgacaagcggttgtttataaggagggataaaggcagtcatcacctcttctttgagttttccgtctgaccatgcctgagcggcacgctgatgcgaacggtgcgctaatgcatcttgctgttctcgggtgatgccgtaggttttcgccatttgctctgcggtgtcgcccatccgcaagccggtagaatattctgctaccgcaggtggtacgggcattaagtcgcgcaaacgcaggcgagagaagagtttcagtcgctggctcatggtacgagctttgttgacatcaaccagcacgcgcgccagttttttactgacgccaattggcaataccgaagaggaatctgccccaccggcaatccccgctcgaatagttcccgccatcaggctttctgcgacgtttgcaactgcctggaaactggtagcgcaagcgcggctgacgctgtaagcatcggtatgtacattcattcccgtaccgagaacaatttcacgcgcaatgttgggggcttcaggcatttgtacgacctgaccaaagaccagttgttcaatcacttcggcggggatctcgctgcgtgccagcagttcgcctaccaccatcttccctaaatcaaccgcgggaatgccatgaaaagccgtcgcctgacgggcaaaaggcgtacgtaaaccgctaacaatggcgatacgatcgccctggcgggtaaccagcggtaaaacctgacccataacactcccctgtaaaaaaataaataaagtggtctgacctgatcatagtcttaaccatttttttacatttagccaagtggagaaaagggaaagtgggagctatgacacagagagaaaagaagaagagaaaagaaaacgcccctgccagcaactgacaggggcgtacgtacccgagaggaattaacgcagacccagctggaaaatcagcatttcagcttcgcaggcaaaagtgaaatcgatatccaggcgcacaccgtcagactcttcagtgaaagtcggggtgattttgcaaggttcagattccacgctacgggctttttcagtcagcgccgccagcgtttgctctgcttctgcgcggtttgcaaacacgcggctgtaagacgcggtgcagtcggagttgtccataatggtgccaacatccatacagcagcaaaccggggtttcatcagcactacatttactcatcgttgatttcctctgtatgtgcacccaaggtgccagataaacgttgtggatattttacgcttccggaaagtgctgctccagttgttaattctgcaaaatcggataagtgaccgaaatcacacttaaaaatgatctaaaacaaaattcacccgaatccatgagtgcgccacctccaaattttgccagctggatcgcgtttcttagatcatatttgaaaaaagatagaaacatacttgcaacattccagctggtccgacctatactctcgccactggtctgatttctaagatgtacctcagaccctacacttcgcgctcctgttacagcacgtaacatagtttgtataaaaataaatcattgaggttatggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggcgcaattgccgatgatgcaggtaacgtcagccgtaaccccgcattgattactatgtttgaccgcccgacattttctgcgggtgcggtttatattgacccggatgtaaatatcagcggaacgtctccatctggtcgtagcctgaaagccgataacatcgcgcctacggcatgggttccgaacatgcactttgttgcaccgattaacgaccaatttggttggggcgcttctattacctctaactatggtctggctacagagtttaacgatacttatgcaggcggctctgtcgggggtacaaccgaccttgaaaccatgaacctgaacttaagcggtgcgtatcgcttaaataatgcatggagctttggtcttggtttcaacgccgtctacgctcgcgcgaaaattgaacgtttcgcaggcgatctggggcagttggttgctggccaaattatgcaatctcctgctggccaaactcagcaagggcaagcattggcagctaccgccaacggtattgacagtaataccaaaatcgctcatctgaacggtaaccagtggggctttggctggaacgccggaatcctgtatgaactggataaaaataaccgctatgcactgacctaccgttctgaagtgaaaattgacttcaaaggtaactacagcagcgatcttaatcgtgcgtttaataactacggtttgccaattcctaccgcgacaggtggcgcaacgcaatcgggttatctgacgctgaacctgcctgaaatgtgggaagtgtcaggttataaccgtgttgatccacagtgggcgattcactatagcctggcttacaccagctggagtcagttccagcagctgaaagcgacctcaaccagtggcgacacgctgttccagaaacatgaaggctttaaagatgcttaccgcatcgcgttgggtaccacttattactacgatgataactggaccttccgtaccggtatcgcctttgatgacagcccagttcctgcacagaatcgttctatctccattccggaccaggaccgtttctggctgagtgcaggtacgacttacgcatttaataaagatgcttcagtcgacgttggtgtttcttatatgcacggtcagagcgtgaaaattaacgaaggcccataccagttcgagtctgaaggtaaagcctggctgttcggtactaactttaactacgcgttctgataacgcgttcgcctggataaagtcacctgcatagcaggtgactttaactcccccacttcaccgaaagtagtgtcctcattgcttacctcctgagttttgcaaacagcctgttggcagcttgccctttcaaatcaataagcggtatccacagacaaacctgaagggaaaggcatattttcaggcgttctgctcgtccttctcaaagagtttacttttctgcatttccaggatactccccccccctggctattgtgcgctcatacactcaaattaaagataggttctaaataaatgagcgttttttgatagtctatttcattaggtaatatatatttgtaacaaatcaatcaaaatggaataaaatcatgctaccatctatttcaatcaacaataccagcgcagcttacccagaatccatcaatgaaaataacaatgatgaagttaatggattagtacaagagttcaaaaacctttttaatggtaaggaaggaataagcacctgtattaaacatctacttgagcttataaaaaacgccatacgagtaaacgacgatccttatagatttaatattaataattcctcagttacttatattgatattgactccaatgatacagaccatattactattggtatcgacaaccaagaaccaatagaattacctgcgaactataaagacaaagaactcgtccgtactatcattaatgacaacatagttgagaagactcatgatatcaataacaaggaaatgatcttcagcgcattaaaagaaatatatgatggagatcctggttttatcttcgataagatatcacacaaactcagacatacggtaacggaatttgatgagagcgggaaaagcgaaccaacggacttatttacctggtacggtaaagataaaaaaggcgactctctcgctattgtaattaaaaataaaaacggaaatgattacttatctctcggttactacgatcaggacgactaccacattcaaagaggaattcgtattaatggtgatagtctcacccaatattgtagtgaaaacgccaggagtgcttcagcgtggtttgaaagcagtaaagctatcatggcagaatcatttgcaactggttccgatcatcaggttgtaaacgagctcaacggggaaagactgagagaaccaaacgacgtttttaaacgttatggtcgagcaataagatatgattttcaagtggacgatgcaaaatataaatgcgaccatctaaaagaaatagtttctactttagtcggtaacaaaattaacgttggccattctcaaaaaatatataagcattttaaggatctcgaaggtaaaattgaagaaaggcttcaaaatcgccaggctgaatatcaaaatgaaattaatcaaccatctgcgccaggtgttaattttgatgatatttaaaattatttttccagttttttgatttttcaacagctgaatatcggaaatagtcagtgacgaacatcagtatttttacataattacgtctaggtcattgtcggtttatctccttttacttgtggtaattgagggataacaacaaaaaaggtgagttttgcgactcaccttttttatttgtttcttattcagaatcaatatcttttaaatcatcctgaatcgcttgtgcgttcggattttcctgcggtttgagttcgccgccattagcgatgaaatcatgacgctggaagtacgcttcgcgcaccataatataaggatcggacgactgacgcagcagaccatcggaatccagcagctgagcgcgggtttcgatcccttcaagcgtccatttacccacagacatcggccaggtcagccaggaaagaaccgggtaaaaaccatccgccatatcaccaccgtcatcacgcagcgtgaagctaccgtagaacggtaactgaacgtaaggcccataacccacgccataatgaccaagcgtactaccgaagcggtgaggttcagtccgttgcagtttcgggttcgccatccctgcaacatcaataaaaccgcccatccccaaaatggtgttcaggaaaaagcgggtaaagtggaccatcccctgataagggtcgccctgcaagaagtagttaaccatcaccgcaggttcttcaaggttgccagtaaagttgctcaaaccgttacgcgccggttgcggaacataatcacgccaggcgacagcgaccggtcgaacaatatacgggtctaatacattgaagttgaagttgtacatggtgcggttgaacccttctaacgggtcagaacgcccttgctgatctgtaccggaactcgcacaccccaccagaagcgtagttcccagagcaagcgccgacaggcgaagcttcataaatgtctccctgtttttttatggcttatgcagtttgccatccatgacggaacgataccgtatccgcctgtttaggtgtgggcgattgtaacagcacgtcaactgatgtccagacgccctgatttgctgatttgatcatagcctggtaatcgccgccctgtaggctacttgattctatagaaacagaaaaaggcaaacgcagccttttctacattttcagagtaactcccgtcagttgcgagcaaaaaagccgctacgctttagctatacgtgctaattcaagagaagagaccatggacaacgacaaaattgatcaacacagcgacgaaattgaagttgagagcgaagaaaaagagcgcggcaaaaaaatagaaatagatgaagaccgactcccctcccgggcgatggcaattcatgagcatatccgccaggatggtgaaaaagagctggaacgcgacgcaatggcgctactgtggtcagccattgcggcgggtctgtcgatgggcgcttcgttactggcaaaagggatatttcaagtcgaactggaaggtgtgccgggcagcttcttgctggagaatctcggttatacctttggttttattatcgtcattatggcccgccagcaattatttaccgaaaataccgtgactgcggtactacccgtcatgcaaaaaccgacaatgagcaacgtcggcttacttatacggttatggggcgtcgtgctgctgggtaatattctcgggacaggtattgcggcgtgggcatttgaatatatgcctatcttcaatgaagaaactcgcgatgcatttgtcaaaatcggcatggatgtgatgaagaacacccccagcgagatgtttgccaacgcgatcatttccggctggctgatcgccactatggtttggatgtttcctgcagcgggtgcggcaaagattgtggtgattatattgatgacctggcttattgccctgggtgacaccacccatatcgtggtcggttctgttgaaatcctctatctggtgtttaacggtacgctgcactggagcgatttcatctggcccttcgcactacctactttagcggggaacatctgcggcggcacctttatcttcgcgttaatgagtcatgcacagattcgtaacgacatgagcaataagcgtaaagcagaagcacgccaaaaagcagaacgtgcggaaaacattaagaaaaattataaaaacccggcataaatggcgagggtttaagcaatcgagcggcagcgtacttaccccgcactccattagcgggtatactcatgccgcattgtcctcttagttaaatggatataacgagcccctcctaagggctaattgcaggttcgattcctgcaggggacaccatttatcagttcgctcccatccgtaccagtccgcaaaatcccctgaatatcaagcattccgtagatttacagttcgtcatggttcgcttcagatcgttgacagccgcactccatgacgggtaaaaagtggataaaataattttacccaccggatttttacccatgctcaccgttaagcagattgaagcagcaaagccgaaagaaaaaccataccgccttctcgatggtaatggcctgtacctttatgtccctgtgtcagggaaaaaggtatggcagcttcgctacaagattgacggtaaggagaaaatcctgaccgtcggaaaatatccgcttatgactttgcaggaggcaagggataaagcatggactgcgaggaaagacatctcggttggcatcgatcctgtaaaggcgaaaaaggcttcgtctaacaacaattcctttagtgcgatttacaaggaatggtacgagcacaagaagcaagtatggtcagtagggtatgcaactgaacttgccaaaatgtttgacgacgacattttacctatcattggcggccttgaaattcaggatattgagccgatgcaactgctggaagtaatccgcaggtttgaagatcgcggtgcaatggaacgagccaacaaagcacgcagaagatgcggcgaggttttccgttacgctattgtcaccggaagggctaaatataacccggcacctgaccttgctgacgccatgaagggataccgcaagaagaacttcccgtttcttcctgcagaccagatcccggcattcaacaaagcactggcaacattttcaggaagtatcgtatcgctcattgcgaccaaagttttacgctacacagccctaagaacgaaagagcttcgttccatgctatggaagaacgtcgattttgaaaataggattatcaccatcgacgccagtgtgatgaaaggacgcaaaattcatgtggttcctatgtcagaccaggtagttgaacttctcactacgctaagctccatcaccaaaccagtctcagagtttgtttttgccgggcgcaacgataagaagaagccaatctgcgagaacgcggtactgcttgtgatcaaacaaatcggctatgagggtctggaaagcggtcacggattcaggcatgaattcagcacgattatgaacgagcacgaatggcctgctgacgctattgaagtgcaactggcacatgcaaacggcggatctgtgcgtgggatttacaaccatgctcagtatctcgataaacgcagagaaatgatgcaatggtgggcggactggcttgatgagaaggtggagtgagcgaccttaacaactatcgaatagcacaaagtcttgcaatccagtgcaaagctttgtgtgtataagttttgtctcatcaaccacagcaagtatcgatcgattaagacttggatgatagacttcattcctttgattattagctgatagaagaaatgttaaagctatttgcaaagtacacctctattggtgtgctgaacacccttatacactgggtggtttttggtgtttgtatctatgtcgcgcatacaaaccaagctcttgcaaacttcgcaggtttcgttgtggctgtgagctttagcttcttcgcgaatgcaaaattcacattcaaggcatcgactacaacgatgcgctacatgctatatgttgggttcatggggacactgagtgctactgttggatgggctgctgatagatgcgcacttcccccgatgataactcttgtcaccttctccgccatcagcctggtgtgcggtttcgtctattcaaagttcattgtctttagggatgcgaaatgaagatatctcttgtagttcctgtcttcaatgaagaagaagcgataccaattttttataaaacggtacgtgaattcgaagaattgaagtcatatgaagtggaaatcgttttcataaatgacggcagcaaagacgctacggagtcaatcattaatgctctggctgtttcagatcctctagttgttccgctgtcatttacacgcaactttggtaaagaaccagcattgtttgcagggttagaccatgcaaccggggatgcgataatcccaattgatgttgacctgcaagacccgattgaggttattcctcatcttattgaaaaatggcaagcaggtgctgatatggttcttgctaaaagatctgaccgctcaactgatggacgcctgaagcgaaaaacggctgagtggttctataagctccacaataaaataagcaatcctaaaattgaagagaatgttggtgatttcaggctgatgagccgtgatgttgtcgaaaatattaaacttatgccagaacgaaaccttttcatgaaaggtattctgagctgggtaggaggaaagacagatattgttgaatacgtgcgagcggaaagaattgctggagatacaaaatttaatggatggaaactttggaatttagcacttgagggtattacaagcttttccacattccctcttcgcatctggacatacatagggttagtggtagccagtgtagcatttatttatggggcgtggatgattttagatactatcatatttggaaatgctgttaggggatatccttcactacttgtttcaatactgtttttaggtggaattcagatgattggaataggagtattaggtgaatatattggacgcacatacattgaaaccaaaaaacgcccgaaatacatcatcaagagagtcaaaaaatgaataaagcaataaaagtatcattgtatatatcttttgttttgattatttgcgccttatctaaaaacataatgatgttaaatacatctgatttcggaagagccattaagccattaattgaagacataccagcatttacatatgacttacctttattgtataaattgaaaggtcatattgattcaattgatagctatgagtatataagttcatatagttatattttgtatacatacgtcctgtttattagcatttttactgaatatcttgatgctagggtgttatcgttatttctaaaagtaatatatatttattcattatatgcgatatttacttcatatataaaaacagaaaggtatgtaactttatttacattctttattttagcttttcttatgtgttcttcatcaacactgtcaatgtttgcatcattctatcaagagcaaatagttataattttccttccatttttggtgtattcattaacatgcaaaaacaataaatctatgcttttgctatttttttcgttgctaataatatctactgctaaaaatcaatttatattaaccccactaatagtgtattcatattatattttttttgatagacacaaactaattattaaatctgtaatatgcgtggtgtgcttgcttgcgtcaatatttgcaatatcttattcaaaaggtgttgttgaattaaataagtaccatgcaacatacttcggtagttatctttatatgaaaaacaacgggtataaaatgccatcgtatgttgatgataagtgtgttgggttagatgcctggggtaataaattcgacatatcatttggcgcaaccccaacagaagttggaacggaatgtttcgaatctcataaagatgaaacgttttcgaatgcactctttttattggttagcaaaccaagcaccatcttcaaacttccatttgatgatggtgtgatgtctcagtataaagaaaattatttccatgtatataaaaaactacacgtaatatatggagaatcaaacatactaacgactattactaacataaaagacaatatatttaaaaacattagatttatatcattgttattattttttattgcttctatttttattagaaataataaaataaaggcatctttatttgtagtatctctttttggaatatctcaattttatgtgtcatttttcggggaaggatatagagatttaagcaagcatttatttggaatgtatttttcgttcgacctttgcttatacataacagtcgtttttttaatttataaaataattcaaagaaatcaagacaatagcgatgtaaagcactaagtttaaattgcgcgccaatcatggcgcgcacaagctataataccaacctaatttctcctcctcttagagtgactatatctcctgatagaattgcggtattgactatcaaatgccctgattcgttgtttattgtaatatctcctctatctgcagacgataacttaaatgcatcattgcccacaacaaaccccctccagaaccaagtgctgatattatcatcaacagtgatagatacatatactaactgattatcgttataagtgattcctgtcttatacttaacataaggacttccactttgattctcgatagacacataacatccaggggttatgtttgtatgcgtcccgcgactatcgccccattaacgccatacgataaatgggatggtgagaaatgggtgacggataccgaggcacagcatagcgtcgcagtagatgcagcagaagcacagcgccagtcgctgattgatactgcaatggcttccattagtctgattcaactgaaattacaggctgggcggaagctgatgcaggcagagacctcccgacttaacactgtgctggattacattgacgcggtgacggcaacagataccagcaccgcgccggatgtcatctggcctgaactgccggaggagtaggccattcaatatctggcgcactggaagtatcgaccagctccagtgcgtccagataatccagccacaaattatattgcgccagttcctcacctttcagacgaccaatagccgctttaccagcccattgtttactgttcatataatcgttggcctgattaatcaattgctgctttttcagttcggctgcagcaatctgttcctcatgtgttggtggtggaatttcagaccatgcaggaaaaccattttctccagcgatacggatttttcctttcggcggtaatccggaaaactcaatatacacttgctcatcaacttcaacagcatcatctggccatgagccagcttgcgtgtaatcctctttcatctccaagggatagaaagagtttgtagtcgcggaatatatgtaattcatttttcactccataaagttaaaagaaattaacaccctaatgcgaaaaatgaagcaccgataccgggtacgcctgctctggaaataaatttcaccgggtcctggttataaccggcacaagctatatagccaacatttgcactgccgggagtgtaatcctgagtcgcaaatacccgcagacatctattcggaaatgcaatcggaaaataggttactgtgtcctgagacgtcagcggaacatcaattggcccccattgaataattaaaccggatggcaatttttgatatccaggaactgaagcagaaagcataaaactacccatatcaggtatctgattcgcccctgtccctacatttcttttagccgcttctcccaaaccaaggttttcgagagccttttgcaccgtgccgtccaatttgatatcgccaaacggattcttgcggcttaacagcagcgcacgaagcgcggtaagcagctggtcatgccgccccttctccaggctggcaccggaggcctccacaacgctgcaaagctcctcctgcaacatgtcaaagtagtcatcatccagatcggtggcaggcgtgccggtctgggggttaccacgggtacgggggattaccaaaggcagcacctttaagctccgcaagacgttctgaccagtcatgcgccagcgcgttgtcttccgcagtgtaatacgcggcacatttggcgttatcaccatcagtaaacagatccagaacaaacgggccaaacagggtgttaattccccagaaaatgttgtccggcgtgcgccactgatcgcccacttccttcagttcatgggctggtttgttccgcagctccaccagcgcctggcaatatttattactcattaagcccccacgtaattccctgagagataccactcttcacctgatgcagcccgcttactgcttttccgtaaacaccgttcacgacgcgccagaaaattgtttcgttctggctgggagtggctttcacggaatgccgccatccacaccgttgcagcacgacggtataagcccctggactccagttcttccgcctggcgggtcaggcacaaaatcacccgcgggtcgttagtgccgacatagaaattgcgcacaggtctggtttcacgaactggttgtggttccggatcctgcgctctctcagtcaggcgcgggaaatgtctgtgtgtatctccttcacaacggtgagccacacgcccactctgacgtaacttgcttgctgactgcagaacgcgctgccgtgagtaacctgcaaaagcatccgcaatgtctccggaagtacagcccggatgggcttcaatgaatttctgaacgtcattcaaaagactcatgctcaccccctgaatcctgccgggatctggctgtagtccacattgtcgtaactggctttgaagtacgggtcttcgcgtttttctgtgtacgtgctgacggacggcgataagcgcagggaaagctcatcccatttttcccgcagcttcgacgggctgagcacgttacggcaccagaacggatcgcggctgacgcggctgtacatctcgcagatttgtttgtgagtacgaccatcctgcacacacatcaggcgaatttcgtttgcccaggctgtccagttcggttctttgggacgaaccacctcgccgtcacattcggcggcctgctcgtacagggcgatgatttttttccagagccactgtgcgcaggtcaaatcatcctgcgttccccactggcgctttttagggctgaatacaaccgcatcaggatggcgagttaaaaaatcctgttcatccgtctgcgtgtccggttgcgaagcgtccggacgagaaggttttttatctgacggatcatgttttgattttactgacggatccccgccagattctgacgggtgaaaacccgattttttgccagatttcgacgcatcaaattttgacgggtcagattttgatgcgtcagattttgacgggtcagagtctgacagttgagaaaatgccgctgcctgaagcttcgcaacgttaagctgataaacattcgacgcattgcggttatgatgaggagcagcaaaatggctagcgaacgcagtactgatgtgcaggcatttatcggggagctggacggcggcgtatttgaaaccaaaatcggcgcagttctcagtgaagtcgcttccggtgtgatgaacacgaaaaccaaaggtaaggtctcactcaacctggaaatcgaaccatttgatgagaaccgtctgaaaatcaaacacaaactctcatatgttcgcccgactaaccgtgggaaaatttccgaagaagacaccaccgaaacgccgatgtatgtcaatcgcggtggtcgcctgactattctgcaggaagaccagggacaattactgactcttgccggtgagcctgacggaaaactccgcgcagcaggtcattaatatcattcttaattaactaattatttatctcatcactgaatatcttaatatagtgaggacttattatgtctcagaacttagacgcaaccgcaattaatcaaatccatgcccttatttctgctcagggtgttaatgaaattatcagtaagattggtgccgatgctgtggcattgcctgagaatttccgcattcatgatctggaaaaatttaatttaaatcgcttccgtttccgtggtgcgctttccactgccagcatcgatgactttacccgttattctaaagatcttgcagatgaaggcacccgctgctttatcgatgctgataatatgcgtgccgtcagtgtgcttaacctgggtactattgatgaaccaggtcacgcagataacaccgccactctcaaactgaaaaagacagcaccgttctctgccctgttgtctgttaacggcgagcgtaactcccagaaatcactggcagaatggattgaagactgggccgactaccttgtgggctttgatgctaatggtgacgccattcaggcaacaaaagcggctgcggcaatccgtaaaatcacgattgaagcaaaccagaccgctgattttgaagataatgacttcagcggcaaacgctccctgatggaatctgtcgaagcgaagaccaaagacattatgccagtggcatttgaatttaaatgcgttccgtttgaaggtctgaaagaacgtccgtttaaattacgcctcagcattatcactggcgatcgtcctgtactggttctgcgcattattcagctggaagcggtgcaggaagatatggctaacgaatttcgtgatctgcttgttgagaaattcaaagacagcaaagtagaaacctttattggtactttcaccgcctgatttcattactgcaaatgcccctgcgggggcatttatggaaacgtaattaactcaataatcaccggatggtgagggcttccttttacccaaactcagcgcggtgcagcgcatatacgtggagaacaaaatgtcatttattaaaactttttccgggaagcatttttattatgacaagataaataaagacgacatcgtgattaacgatatcgcggtttccctttcaaatatctgccgctttgccggtcatctttctcacttctacagtgtcgcccaacatgcggtgctttgcagccagctggtgccgcaggaatttgcttttgaagcattaatgcatgatgcaacagaagcgtattgccaggacatccccgcaccactgaaacgccttcttcctgactataaacggatggaagaaaaaatagatgcagtaatccgtgagaaatacgggttacctcctgttatgagcacgccagtgaaatatgccgatctcattatgctggcaaccgaacgccgtgatctcgggcttgatgatggctctttctggcctgtactggaaggcatcccggcaacagagatgttcaacgtgattccactggcaccgggtcatgcctacgggatgtttatggaacgttttaacgatttatcggagttacgcaaatgcgcatgaatgttttcgaaatggaagggtttcttcgcgggaaatgtgtaccgcgagatctgaaagtgaacgaaacaaatgctgagtacctggtacgtaaattcgacgcgcttgaagctaaatgtgcggcactggaaaacaaaataataccagtgtcagctgaactgccaccagcaaatgaaagtgttctgttatttgatgctaacggagaaggctggctgattggctggcgttctctctggtacacctggggacaaaaagaaaccggagaatggcagtggacatttcaggttggggaccttgaaaacgtcaatatcactcactgggcagtaatgccaaaagcaccggaggctggagcataatgaccacatttaccaataaagaactgattaaagaaatcaaagaacgaatcagcagcctagaggttcgagacgatattgagcgccgtgcttatgaaatcgcactcgtatctctggaagtagagccagatgaacgcgaagcctatgaattattcatggaaaagcgtttcggtgacttagtagatcgtcggagagcaaaaaacggcgataacgaatacatggcatgggatatgactctcggttggatcatctggcagcaacgagctggtatccatttttcaacaatgtcacaacaagaggtgaaataatagagccatacagcctcacactcgatgaggcctgtcagtttcttaaaatatcctgatctaccatcgccgtcatagagcgtatttttattacctgatttgcaggttcgattccctattcggagatagcactcatgcaacacgaactacagcctgattcactggttgatttgaaattcatcatggctgatactggctttggtaaaaccttcatctatgaccggattaagtcaggcgacctgccaaaagccaaagttatccacgggcgagcaagatggttatatcgtgaccattgtgaattcaaaaataagctcttaagccgcgccaatgggtaaaatagcgggtaaaatatttctcacatctaaaaaacaccattccaatcaatcccctgctgcttcaagtagatgtctgcaggggacaccatccttgtgtttatccctaaaaccacataaaaaccgtaaattaaattcgaactagcaggccgaataaggcacaccaggaactcgtggttttattcattatgaagtggtttttacctgttctcttagccagataataaacgcttcaatttttggccactgcctgcccggtaatgtggtgatgtaataatgctgatggcatttcaccgtcatatcgccaaacggcgcgacgagctcaccactggcaagccttttttgtaccaggcgttttcttcccatcgccaccccaatatgattcatcgcggcaataacagctaaatcagaacgatcaaagccaattccagaagatgtcggcaaattaaccgcataatgttgcgcccaactatgccattcatccgtaccggagtcgttgctccatgcctgtctgtcatggagcaacgtacagtgacacaggttaattaccgtgttggttaaagcatgtctttgagcgtattccgggctacatactggcaggatttcttcatccatcagaaagtgatgagtgagttgcgctgacggcgcatcatcaaagtagatcgccaaatcgattccggcacgttgcagattgacgttgtcattaccagtgagcacggtgagcgaaatagacggataccggcgtgtaaagtcacctaatgcgggcaccaaccagcattgggcgatagagggccgggaatacagagttaacgttcccgataactcctgatttttgatatcaagaatttcctggttcagggtatccagcgacgattttagcgcccaataaacacgtttcccctcgtgcgttaattccactttgcgatgggaacgaacaaacaactgaatgcccaattcttcttccagctgattgatacggtgacttaccgcactggggctcagcgacaattcctctgccgccagggcgaaggactgatgcctggcagccacttcaaaagtatgcatttttgataattgccagccgttaagcagccgatttcttatttcacgaaggggttccataatcacctcatttttcgcttaagtgtaaaaaaatagcggcaaaatttcagctatgagatgagctaaagtgaaccatatctcaattcaccttcatttttagatgtaaatcactccattgatgcaatttacctcatgtgaaaggcaaattttatcgtttgtcagcctgcgttgtttttttgtccaatatcatcaggttaatcacaggggaaggtgagatatgcactctcaaatctgggttgtgagcacgctgcttatcagcatcgtgttaattgtactgaccatcgtgaagttcaaattccacccgtttctggcgctgttgctggccagcttcttcgtgggaacgatgatgggcatggggccactggatatggtaaatgctattgaaagtggaattggcggaacgctggggttcctcgcagcggttatcggccttggcacgatactgggaaaaatgatggaagtatccggggccgcagaaagaattggtctgacacttcaacgctgccgctggctttcagttgatgtcattatggtgctggttggcctgatttgtggcatcacgctgtttgttgaagtgggcgtcgtgctattgattcctctggctttttcaattgccaaaaaaaccaatacctcattattaaagcttgccattccgctatgtaccgcattgatggcagtgcactgcgtggttcctccacatccggctgctttatatgttgccaataagctgggcgcagatatcggttcggtgatcgtctacggtttgctggttgggctgatggcatcactgatcggtggcccacttttccttaaatttctgggtcaacgactgccctttaaacctgtacccacagagtttgcagatctcaaagttcgcgatgaaaaaacactaccgtcattaggcgcaacgttattcaccatactgctacccattgcgctgatgttggttaaaacgattgccgaattgaatatggcgcgtgagagtggtttgtatatcttggttgagtttattggcaaccctatcactgccatgtttatcgccgtgtttgtcgcctattatgtgttgggtatacgccagcatatgagcatggggacgatgctcacacatacggaaaatggcttcggttctattgctaatattttgctgattatcggggccggaggcgcattcaacgccattttaaaaagcagcagtctcgctgatacgctggcagttattctctccaatatgcatatgcacccgattcttctggcctggttagtggctcttattctgcatgcggcagtgggctccgctaccgtggcaatgatgggggcaacggcaattgttgcacccatgctgccgctgtatcccgacatcagcccggaaattattgcgattgctatcggttcaggtgcaattggctgcactatcgttacggactcgcttttctggctagtgaagcaatattgcggcgctacgctcaatgaaacatttaaatactatacgacagcgacatttatcgcttcagtcgtcgctctggcgggcacattcctgctgtcatttatcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatcgcaatcctttccctgggtgagcgatgctgccgatggcgcagacttaagatccccggtcttacccgctataaccccctccttttatcatcacccaacgcctttcgctgtaaacggcggtttcgcaaaccaaaccaaaaccgtaagtaagataaaagcaatagccgccatacggaaaatctcatttgcagaaatagaaagtgactgctgggttatttcattattaatttcattaagaactcctgaaagcgaaccataatatttatccataatttgtgacgatgaattaaacacggggttaaattgatcgatggttgctgtcaactgactatggtgtaacgattcgcgtcgtccccacagcgtcattgtcaacgacgtaccaactgatcctgacaaggtacgaaaaaaattactcatactcgaggcattggcaaatttattatctggcaagcctgaaaacgaaatcgttgttaagggtaaaaagaaacaggcaacggcgaatccctgaaaaaactgcggcaaaatgatgcctgtaaaatcaatcgttggcataaatgtcacagaacgccagtaatagcaaaccgcatacatcaaaaaactaaatgtcactaacaaccgcatgtctattttgttgccataacgtcctatcaaaggtgaaattaatagtggcatgatgccgatgggcgcataagcaagtccggcccatatcgcattataccccatcgtttcctggagtaactgcggcataaggacgatcgctccagagtaaaataaatacgcgcatgtgatactcacaataccaatggtgaagttacgggacttaaacaaactgagatcaagaatcgggttctctgaggtcgactcccaaatgactaaagagatcagagaaataactgatactactgttaatattattattgtactcgagttgaaccaatccagatcgcgccctttatcaagcataatttgcaagccaccaacaccgagcactaacagggtcagtcctggtagattcattttgaccggtgaagtctcagtttctcttcctttaagtaaggttaagcataatgtcaggacgataatccccatagggacattgattaaaaatatccaaccccagctaaagttatcacaaatataaccgcccaatatcggcccacatatcggagcgataatcacggtcattgaccataatgccagagcaaatgttcttttttctggcggataattccttaataataaactctgtgacagtggaattaacggccccgccattaacccctgaacgactctaaaaaatatcagcacatcaagattggtcgataggctacacattaatgaagacagcgaaaaaaaagtgactgaaagtaaaaataatcttaattcgcctattctttgtgccaacctgccagtaacagggatcgcaatggcatttgctacaccaaacgaggtgataacccaggtgccttcgtctgttgatgctcccagaaagccagatattgtcggtattgcgacgttagaaatagtggaatccaacatttgcataaatgtcgctaatgacaatgcaatagtgacgcaccataacgtcccaccggttaatggtgccggagttgatttagtgattgccattaaagttgtccattatgcgaaataatgttgctaatttctttttctatcggactggtatcgataactaaagccttactggtataagccggcatggaggtcacggttgaagccagctcaggcatctcggcaatgtcttcgttcttcgtatcaatagttgctgtcatcgataaaccaatacgcaaggggtgttccatgagttcttttggatcaagagaaacttcaaccggtacacgctgaacgattttgatccagttccctgtcgcattttgtgcaggtaataaggagaacgcattgccggttcccatattgatccctgtcacccgaccatgaaacacaacattttcaccataaagatcgctgataatattgaccgattgaccaatccgtacatccgtgagttgtgtttctttaaagttggcattaacccacatttgacgtgccggtacgacagccattaacgattgtccggggctcactgtttcgccgacctgaacacttctctgggcaatatagccggtaaccggactcttaatatccgtacgtttaagcgccaaccaggcttctttagttgcatccgccgcttcaacgacttgtggctgacggtttaatggtgtgttcattactaaagctttattcgctttataagcctggatagcggcattcaatgccgctttgctacttattaacgtatctttggtatgctccagcgtttcttttgaaataaccccctgcttcgctaacggcactcgacggttataatcttctaaagattgttgatactgaatacgtgctgaagcgacttcggcactgtattgtttatcctgtaagtatagtttattcgtttgccgaacaatatttgccagattatttttagctttattgagtgcgatagtggcatcagttttatccagtgaaactaaaatgtcaccttgtcgaacgtagttcgtatctttatgattaacgacagtgacactacctgagacttgtgcagaaattggatctgcattccccgtgacataggcgtcatctgtactaatcatgtcttctaattccattgaccaataggcataggcacctgaaaacgcaataaataaaactaccgccaataaagaaaagtattttcttctgttagaatgttttttatttgaattaatctgttccactattatctctcatttctcatagatgaaatttatgaattgaatgaaaagagcattcattcttcatatcaaacacagtgcatgtgttgcacattatcccaggaacgttggaggcctaatttaaatgaggtgcaaaaaaaacaacagaggactaaaccgtggcttttgcaatacaattcttacgcctgtaggattagtaagaagacttatagtgccaacttgaaactataaatcatcggtacaatccctgattttattgttgacatttcatttatgccgactatttatatggtatacttgtcgaattatcttaaaggaagctcagattttcttatttttattgagaaaatgagatgacgccttatgtctgtattactacagggagaagggagatgcttcattgcaaagggaataatctatgaacgcaataattattgatgaccatcctcttgctatcgcagcaattcgtaatttattgatcaaaaacgatattgaaatcttagcagagttgactgaaggcggaagtgccgttcagcgggtggaaacacttaagcctgatatcgtcatcattgatgtcgatatccccggagttaacggtatccaggtgttagaaacgctgaggaagcgccaatatagcggaattattattatcgtctccgctaaaaatgaccatttttacgggaaacattgtgctgatgctggcgctaatggtttcgtgagtaaaaaagaaggcatgaacaatatcattgcggctattgaagctgcaaaaaatggctactgctatttccccttctctctcaaccggtttgttggaagtttaacgtccgaccagcaaaaactcgactccttatcgaaacaagaaattagtgtcatgcggtatattcttgatggcaaggataataatgacattgctgaaaaaatgttcatcagcaacaaaactgtcagcacttataaaagtcgcctgatggaaaaattagaatgtaaatcactgatggatctttacacattcgcacaacgtaacaaaatcggctaaccacatgaagtttttaccctatatttttcttctctgttgtggtctttggtcgaccataagtttcgcagacgaagattacatcgaatatcgtggcatcagtagtaacaaccgtgtcacacttgatccactacgtctgagcaacaaggaattacgttggttagcgagcaaaaaaaatcttgtgattgcagtacataagtcccaaacggctacgttgttgcataccgattcgcagcaacgggttcgtggtattaatgctgattatttaaatcttttaaaaagagcgttaaatatcaaattaacactccgggaatacgcagatcatcaaaaagcaatggacgcgcttgcagaaggtgaagtcgatatagtgttatcacatttagttacttcgccgcctcttaataatgacattgctgcaaccaaaccattgataattacctttccggcgctggtaaccacccttcacgactcaatgcgaccgcttacctcaccaaaaccagtaaatattgctcgggtagcaaattaccccccagacgaggtaattcatcaatcatttccaaaagcaacaattatctcttttacaaatttatatcaggcattagcatccgtctcagctgggcacaatgattactttattggtagtaacatcattaccagcagtatgatttcccgctatttcactcactccttaaatgtagtgaaatattataactcgccgcgtcaatataattttttcttgaccagaaaagaatctgtcattcttaatgaagtactcaatagatttgttgatgctttaacaaatgaagttcgctatgaagtatcacaaaattggcttgatacaggaaacctggcctttctgaacaaaccattagaactcactgaacatgaaaaacagtggattaagcagcatcccaatttaaaggtgctggaaaatccttactcgcccccctattctatgacggatgaaaatggctcggttcggggcgttatgggggacattcttaatattattaccttgcaaacaggtttaaatttttctccgatcaccgtttcacacaatatccatgctggaacacagcttagccccggaggatgggatataatacctggcgctatttatagtgaagatcgagaaaataatgttttatttgctgaagccttcataacaacgccttacgtttttgtcatgcaaaaagcgcctgacagtgaacaaacattaaaaaaaggaatgaaagttgccattccatattattatgagctgcattcgcaattaaaagagatgtatccggaggttgaatggatacaggtcgataatgccagcgctgcatttcacaaggttaaggaaggtgaacttgatgctctggtcgcgacacagctaaattcgcgttacatgatcgatcattactatcctaatgaactttatcattttcttattcctggcgttccgaatgcatcgctttcgttcgcttttcctcgcggagaaccggaacttaaggatattattaataaagcactgaatgcaattcccccaagcgaagttctgcgcctgacggaaaaatggattaaaatgcccaatgtgaccattgacacatgggacctatatagcgagcaattttatattgttacgacattatccgttttattagttggcagtagccttttatggggattctacctgttacgctcagttcgtcgtcgtaaagtcattcagggtgatttagaaaaccaaatatcattccgaaaagcactctcggattccttaccgaatccaacttatgttgtaaactggcaaggtaatgtcattagtcataatagtgcttttgaacattatttcactgcggattactacaaaaatgcaatgttaccattagaaaacagtgactcaccctttaaagatgttttttctaatgcgcatgaagtcacagcagaaacgaaagaaaatcgaacaatatacacacaggtatttgaaattgataatggcatcgagaaaagatgcattaatcactggcatacattatgcaatcttcctgcaagtgacaatgcagtatatatttgtggttggcaagatattactgaaacgcgtgatctaattaatgcactcgaggtagaaaaaaataaagcgataaaggctaccgtagcaaaaagtcagtttctggcaacgatgagtcacgaaataagaacaccaataagctctattatgggcttcctggaacttctgtcgggttctggtcttagcaaggagcaacgggtggaggcgatttcacttgcctacgccaccggacaatcactcctcggcttaattggtgaaatccttgatgtcgacaaaattgaatcgggtaactatcaacttcaaccacaatgggtcgatatccctactttagtccagaacacttgtcactctttcggtgcgattgctgcaagcaaatcgatcgcattaagttgcagcagtacgtttcctgaacattacctggttaagatcgaccctcaggcgtttaagcaggtcttatcaaatttactgagtaatgctctcaaatttaccaccgagggggcagtaaaaattacgacctccctgggtcacattgatgacaaccacgctgttatcaaaatgacgattatggattctggaagtggattatcgcaggaagaacaacaacaactgtttaaacgctacagccaaacaagtgcaggtcgtcagcaaacaggttctggtttaggcttaatgatctgcaaagaattaattaaaaatatgcagggcgatttgtcattagaaagtcatccaggcataggaacaacatttacgatcacaatcccggtagaaattagccagcaagtggcgactgtcgaggcaaaagcagaacaacccatcacactacctgaaaagttgagcatattaatcgcggatgatcatccgaccaacaggctattactcaaacgccagctaaatctattaggatatgatgttgatgaagccactgatggtgtgcaagcgctacacaaagtcagtatgcaacattatgatctgcttattactgacgttaatatgccgaatatggatggttttgagttgactcgcaaactccgtgagcaaaattcttccttacccatctgggggcttacagccaacgcacaggctaacgaacgtgaaaaagggttaagttgcggcatgaacttatgtttgttcaaaccgttgaccctggatgtactgaaaacacatttaagtcagttacaccaagttgcgcatattgcacctcagtatcgccaccttgatatcgaagccctgaaaaataatacggcgaacgatctacaactgatgcaggagattctcatgactttccagcatgaaacgcataaagatctacccgctgcgtttcaagcactagaagctggcgataacagaactttccatcagtgtattcatcgcatccacggtgcggctaacatcctgaatttgcaaaagttgattaatattagccatcagttagaaataacacctgtttcagatgacagtaagcctgaaattcttcagttgctgaactctgtaaaagaacacattgcagagctggaccaggagattgctgttttctgtcagaaaaatgactaaatagcggctcccacaatgttcaaatgtgggagctatttaccagcacatcttacatttatgatgagaactcctggcgaatttgttccccatgctggtcgagcgttgccgctcccggcataacatgcgggtccgcgcagccgctgatttttatcggattacccggcatcattattcccccggcttcaatcaacatatttctcgcctgagtttgtggcaatttaatggcctcagccacacttaataacggcgcgacgggtacaccaacttcatgtattctggctaaccaaacttcagctgcctgcgtttttaacgtccgctcaatatattgtttaagaatagcctggttttgtacgcgtaaaatattgctgctaaatcggggatcattaaccagttccgtaagctccagtgcctggcataacgcagaaaaaagcttgtcattaccacaacaaatcgtaatcggcttatcctgagtattgaaaacatcaaaaggtgccatgtagggatggcgatttcccagacgttgtggtgacttcccagttgcgatatatgccatcagaccatgctccagaaaactcagcgtggcatcaaacatcgctatatcgacatgcgcccctctctggctcttttcgcggccataaagtgcactcactattccgctgaataaatagacaccgccgcatagatccgcaagagatgtaccaacgcgcactggcggagcatcaggatatcctgtttccatcattatcccgctcattgcctgaatgatggtatcgtaggcaggagcatcttttagcggaccggtatgtccgaaacctgacgatgaagcatatatgaggcgcgggttgatttcttgaagcgtttcccatgaaaaccccagtttttccattgtacctgggcgaaaattctcagctaatacatcagcttgtttgagcatatttataaatatacttttatcgtgatcattctttaaatcaagaaccacactctctttgccatgattaataaaactgtaatagagtgactgtccatccacatagggaccaaatgtgcgggtatcatcaccatgacccggcggctcaactttaattacccttgcgcccatattacaaagaagttgagttccgaaaggtccattaaggacatgtgtcatatcgataactaataagccttcaaacggccctttgctttcattatttgtcatttgcttatgccttgaaaaaagccgaaggtgaaaagacacttcggcatttatgtaaaatcaataacatgattaattatgaaaccagtcgactgacataaatccacaagggagccgtgacgacaaagcccagtacgctcacagccaatgacgctgtaccagtacgggtgtagacattaaaccggctggcaataatgattccggagaatgccggcggtaatgcgcctgccagtaccatcatctgcagatgttcgctgttcaaatgacatgccataccaacgagaagcagtgccagtggcatcagaatcagcttcaggaaggtgttataagcaatttcggcactgaactcgaatttatgtgcagccagagtcaaccccgcagcgaataccgctacccctgagttagccttcgcaatcagattaaaggttgggtcccatgctgccggaatttttaccccaaccaacaccaggatcgttgccagaacaggtgcccatactactggctcctttgccgcagaaattaatgcgctcagattactattcttcttaccatccgctcctgaagaaggattcagcaaatacagaccaataggaatagtaattgcgttaacaataatagaaataattgctaccactaaacctgttgatacggaatcaccataaataggatcgagaactgcaaaccccaggaatccaatggtaggtgaacctgcaattaatgcacatacagctgcttctgcatgggtacgtttaaaaaatttgtagcaaccgaaccaggagaaaaagaaacatccgacaataaccacaagtgatacaagggtcagacgagtgtccgcaaaaatcatttccctgtttgcccgagtaatagatacaaatagagccgcaggaagcgcgtagtttaataccagtttattaaatgcccgagcttgatcttctgaaaatgtttctcgtctgccgctaaaataacccaacagcatgattacgataataggcaataaatcgccaataaaaaatgttagcataatagtatttccgataagggtcccctcaccatcgcataatgagttggcaagaggagacgatgtcagtatttaattaccagcgacttgttttgggttaagtttggtaatatggccactttcagttcctgctgcagggtcgatgaccacattaataatggtcggtttgcgcgactgaataccggtggttaaagcatgacgaagttcatctgtcgtggtgacgttatagccaacgccacgaaacgcatccattaatttgtcataccttgcatggtgcaacagatccgttggtgatggtgcaccagcgccactgagatcaacaccgtctcctctgtagatgccgccattattaaaaataacgatcgtcaccggcaggttatatcgacaaatcgtttcaatttccatcccactgaaaccaaaagcactatcaccttcaatggcgacaaccggagaaccagaagtcacgctagcaccgatggcatagcccataccgatgcccatgacaccccaggtaccacaatccagacgacgacgtggtttatacatatcaataatatttcgtgcattatccagggtatttgcaccttcattaactaaataaatatcctggttctcgcgcaatacgtcgcgcacagcacttaatgcattaaagtaatttaatggttgagtatctgtacttaatttttcatgcattttttgtgcattttgctgcttgtggatatttaaaatatcgcgccataccagtggagtcgtaaatgtgttttgtttcagttctgccagcataccttgcatactggatgcaatatcaccaacgactggcacagcaatggggcggttgctgtcaatttcctgcggttcaatatccagttgaataaactgtgtatctgccgcccatccttttttaccgtgtgccaataaccaattcagtcgtgcaccaacaagcatgacaacgtcagcatttgccagggcaaacgaacgcgcagctgccgcagaaagtggatgcgtatcttcaaggatccctttcgccatagacattggcaggaatggaatctgagcactttcaataaattcacgaagctgttcatcagcttgtgaatacgccgcgcctttgccaaggataattaatggccgttcagcttttgctaaaagcgaaattgcgctagtgactgacttcgggcatggcaataatgctggcgacggattttcaactttaacaatcgtggttaacgcttcgtctttttccatcgtcgcggccaggacatttgctggcaaatcaagataaactccgccagggcgacccgatacagagacccggatagcgcgtgccaatgcaatgccaagatcctgcggctgattaacgcgaaatgctgctttggcatacggttttgccgcattcatttggtccagctcttcataatcaccttgctgtaggtcgacgatcgcgcggtcgctggagccgctaatcatgatcatcggaaaaccatttaccgttgcgttggccaatgcggtcaaaccattgaggaatcctggcgcagaaactgtcaggcagatccccggtttttgggtaagaaaaccgcttgccgcagcggcatagcctgccgactgctcatgacgaaaaccaatataacgaatgccttccgcctgggcatggcgtgccatatccgtcacaggaatacctacaacaccataaatagtgtcaatattattctgttttaatgcttcaacgatgatatgcataccatctgtcatttgaagttgatctgacatgattaataacctcgaaatttttataaattgggagccagaagcccccgttaatatcagatggcgtggttttgcttcattgcagcaatttcatcgtcgctataacccagctcctgcaatacagcagcggtatgttcacctaatagcggcgcagctttaatatccggcgtaaaggcagagaatttcattggacaaccaacggtcagatattttccacgcaacggttgttccacttcaacaacactgccactttggcgcaaagagggatcaagtgaaatttctttcatacttaaaaccggtgcacaaggaatatcaaactgagtcaaataggccaccgcttcatgtttatcaatagtgacagtgtatttttcgatttcagcaaaaatatcgaaaatatgtggctgtcgtgcatgggctgtactgtatgccggatcggtaatccattctggtttgccgatggctttacaggtgttttcccagttttgctcctgaatagtgaaataaatataggcgttaggatcggtttcccagcctttacatttcaggatccagccaggctgaccgccaccacctgcattaccaccgcggggaactgcatcaccaaatgtaccattcggatactgcgggtattcttccagataacccaatttatcgagacgctgctggtcacgtaatttcacgcggcaaaggttcaatacggcatcctgcattgacatggtgactcgttgcccacgccccgttttttcgcgatgcagcaaagcagcaagtaaaccgatcagcaaatgcattccggtgttgctgtcacccaacgctgcagcgcttaccagcggcggaccatcccaaaaacccgtagtggatgccgcgccacccgctgcctgagcaacgttttcataggcttttacattcacataaggcgaacactcatcaaaccctttgatcgaaccaaaaatcagacgtggattgatttcttgaatatgctcccaggtgaagcccatgtgatcaatggcccctggatgaaagttctcgactaagatatcagcttcgcggatcagcttttccattacctctttgccttccgctgttttggtatttaactcaatagaacgtttgttactgttaagcatggtgaagtaaagcgcatcgatatcaggaatatctcgcagctggtgacgcgttacgtcaccaacgccgggacgttcaattttaataacgtcagcgccaaaccaggccagcatttgagtacaagatgggccagattgcacaccggtgaaatcgagaactttaattccttgaagtggagttgacatagcaatacctattagttaattaaatatgtgttaatttagcgtttatttaaggcgtaatatcttctataaataacccgcaaaatatcgtcgtagctgcactcgatatttttaaaatcctgtatcaagtgctgaaaatcatttcatcgccacttccaattcctttctgcatggtaagtagtgaggacgaaaagaagaatatgataaatattgattcgtggtaatcagagagagtcgcgacatttgtgatgttattcttacaactgtaagaagcgccggtgatttacaagcaagggtatgattacgctttttaaagcgtaccataaaacataacataataaatgatttgtgatgacacgggattattgcggtttactttgaggaatataaaatgcgagtttatagcaccgcgagcgccaaataattttatgaccacaacctgtcgtattgtggtcataaaaaattgtcggctggagggagttaaatcctttacctcaatatactgcctgtcagcattagttcacaaacagtgcttcgctatcgacgatgattccatcttccgcacctttaagcgccaggtttgcctcgtagtattgctttttatcaagcagtttctgcgcatcagcaagtgcattacgagtctgtttaagtggcatcagatattggttttccattacgccaacaccggccaggcgaagctcttccattgcgccctttttatcccctttcgccattttttcattggcaatttttatcgcggcttctttttcgggagttgctacataactctcagaaattccgacagatgcattaatgacaatatattggtcatcattgagattggtctttttacctggcttagcgaactttgcccattcggtactgtcatctgacagcaaagcggaagcttcattggtcagttcttttgccttttctggatcgccatgaaacagagccaggcgcgctacctgcacgtcacgcatcgcatataaaccttgttcagagatacgctctgctgccgctgccgttttctgggtttgctgaacttgctgagtttgctgttgtgccgctaccggagcattatcagcagcccatacagttgaagatgccagaattgctgtgaccatcgtggccataattaaacgtttcatacttacctcattctttaacagttttagaaaacgccgccatcatattgggtgagcatgaaatgagaaatcagagagcaacggtcattttgaaagggttatcttacagttgtagttattatcgcaagaagtattttagtcttacaattgtaggaatatgcttcctgtcgcagagaactattcttatataccacaaagagatgtcatttattatatcgatgtaaatactgattaattaaatgtaaatacagccataacatcgtaggttctcagtgaaccattttcaggataactttctatgaaagtaaacttaatacttttcagcttatttttattggtctctattatggcatgcaatgtttttgcattttccatttcgggtggtggaagtgagaggagctataaagagactgaaaaaacatcagcgatgacgaccacacactctacaaaacttcagccatcacaggcgattttgtttaagatgagagaagatgcgccaccattaaacctcacagaagaaatgccgcccccttttccgacaaaggcgaattatcttattcatcctgtgcgatagcgtctttcacatggcaggtgaacaatcatgtctgatgctgatgtgaacacctgcccaaatgagccatcctgacccactaccgcctgccataccccaccataaagcgaatcatcaagccacaagccggggcaagaaacataaatatccccgtcactagttcattaccgccagttaaccacatggtgaagtaataaatgagtgcagcgaggatcaccatgccgaagaaagaagagaccgccgataccacgttcagtacctgaccgatgtagccgcttacgcagacaatacacagggcgagaaacatccataaattaatcatagctcaacctcctgccgcgctaaaaaacctgtaacttcagtcactttaatagtaagacaatccttaacctctggcaatttttgctaagcatcaatgaaaacagcatgttaaatgcaagactgttgtgtacggaaaaatatttactttgcacgattaataatcagtagctgaaagcagtcagcgagtgataaagtacagataccgcattcatgctcctcgtggttatgtcctgactagtctttacactctttacaggaaccattgtcgtacatgatggcccaaccaattgagtgtaccgctgtcgacatggaatcttctgcgatacaacaattcgtatctacagaaggtaactatgtttccacaatgcaaattttcccgcgagtttctacatcctcgctactggctcacatggtttgggcttggtgtactctggctttgggtacagcttccttatcctgttctctgctttctcggcacgcgtattggcgcaatggcgcgaccattcctgaaacgtcgtgaatctatcgcccgtaaaaacctggaactttgtttcccgcagcattctgcggaagaacgcgagaagatgattgccgaaaactttcgttcactcggcatggcgctggtagaaaccggcatggcatggttctggcccgacagtcgcgtacgtaaatggtttgatgttgaagggttggataaccttaaacgcgcacaaatgcaaaatcgcggcgtaatggttgtcggcgtccattttatgtcgctggaactgggcggccgcgtgatgggactgtgccaaccaatgatggctacctatcgtccacataataatcagctgatggaatgggtgcagacccgtgggcgcatgcgctctaacaaagcgatgatcggcagaaataatctgcgcggcattgtcggtgcactgaagaaaggtgaagcggtatggtttgctcccgatcaggattatggtcgtaaaggcagctccttcgcgccgttctttgcggtggaaaatgtcgccacaaccaatggcacctatgttctctcccgtctctctggcgcagccatgttgaccgtaacgatggtaagaaaagcggattacagcggatatcgtttgttcatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggagaatcgtcgttgtacatttaacaaactgctcttactctttccctcctcaaatcggccataataacctcatggtttttatggcttttttcttaaggttttttccttcgctgaatatctaattattaccgtcagaaattaaactgtcgccgatatgagacacttgtaagttactaaaagtaaataagaaaatgcctcttgtctcgtttcagttttaggcgtacattagcgccgtctcgagcagtttagctcagaattctggggtgatgcccacggtaaaatacagggcttttaaggtcgctttgcccggtgtcaactcactgtatcaggtgtaatgaagtcattcaggcgtaacagtaattacgcggagagatgtaaagtgaaatatttctttatgggcatttcttttatggtcatcgtttgggccggtacttttgccctgatgatctaaaagcaaactgtgcaatgaaaaacaggagccatcaggctcctgtttgcatttctgacgacggtgtttattccgcgttttcgtgaatatgtttgctgctggcgggtagtaaaccgtcggcacggaacatcgctttaatccctctgatggcctgacgaatacggtcgcggttttcaatcagtgcaaagcgaacatgcgtatcaccatagtcgccaaagccaatccccggcgagacacaaaccttcgcttcgttaaggagcttcttggcaaattccagcgatcccatggccgcatatggttccgggattttcgcccagacatacatcgaagccttcggcatttcaaccatccagcccgcttcatgcagccctttaaccaatacatcacggcggcgtttgtactgttcggcaatgtcgcgcacgcactgttgatcgccctccagcgccgcaatcgccgccacctgcaacggcgtaaaggtgccgtaatcgtgatagcttttaatacgagccagggcgctgaccagcgttttgttgccaaccataaagccgatacgccagcccgccatgttgtagcttttcgacagcgtaaagaactcgactgccacatcgcgtgcacccggtacctgcataattgacggcgctttccagccatcgtagacgatatcggcataggccaggtcatggaccaccagcacatcgtagcgtttcgccagcgccactactttttcgaagaactccagttccacgcattgcgcggttgggtttgacgggaagccgaggatcatcatcttcggtttcggataactttcacgaatggctcgctccagttcgttgaagaaatcgacaccttccaccagcggcactgagcgtacctgcgccccggcaatcaccgcgccataaatatggatcgggtaacttggattcggcaccagcaccgtgtcaccatgatccagcgtcgccagcatcagatgcgccaggccctctttcgaaccaatagtgacgatggcttctgattccgggtcgatttcaacgtcgtagcgatcctgataccagcgggaaatggcgcgacgtaaccgcggaatgccgcgtgaagtggagtaaccatgcgtgtccgggcgctgggccacagtacataatttttcgacgatatgcggcggagtcgcaccgtccgggttacccatgctgaaatcgataatatcttcgccgcgccgacgcgcagccattttcagttcagcggtgatgttaaaaacgtagggcgggagacgatcaatgcgcgtaaagcgacgttcagggcgagtgtcagccataatttcctcagattaacgttagcgcccggaccgtccgagcgacgctgccacgatggtggctgttttgaaaatagcctgattaatttctgtctgtccagcgttttagaacattttattaatgacgttaaatgaggaactctgctttaaaaacaggaaatttatctgcgctaacaagaaaattaccactcattttattaacataataatttcaataaatttactaaccagaagtgcattatcaagagatgcattgctaatacaccatttatctatcaatccccttttaaaattgtggtttttcctcaaaaacggcctgctggtcatcagccttcaggttacctatcatagaggtttaatccttattcagagtcacccgtgcacgaaatattcaacatgctgctggcggtcttcgatcgggcagcgttaatgcttatctgcctgttctttctcatccgtatccgcctgtttcgcgaactgttgcacaagtcggcgcactccccaaaagaattgctcgccgttaccgccattttctcgctgttcgccctgttcagcacctggtccggcgttcccgtagaaggctcgctggtgaacgtacgtattatcgcggtgatgtccggcgggattctgtttggcccgtgggtaggcatcattaccggcgtgattgcgggtattcaccggtatttaattgatatcggcggcgtgacggcgatcccctgctttatcaccagcattctggcgggttgtatatcgggctggatcaacctgaaaatccccaaagcacagcgctggcgcgtcggtattctcggcggcatgttgtgtgagacgttgaccatgattctggtaattgtctgggcaccaactaccgcgttggggatcgatatcgtctctaaaatcggcattccaatgatcctcggtagcgtctgtatcggctttattgtgcttctggtgcaaagcgttgagggcgaaaaagaggccagcgccgcgcggcaggccaagctggcgctggatatcgccaacaaaacgctaccgctgtttcgccatgtcaatagcgagtcattacgcaaggtctgcgaaattatccgcgatgacattcacgccgatgcggtggcgattactaataccgatcatgtgctggcctatgttggcgtgggtgaacataactatcagaatggcgatgacttcattagcccgactacccgtcaggcgatgaattacggaaaaatcatcattaaaaacaatgatgaagcccaccgcacaccagagattcattccatgctggtgatcccattgtgggagaaaggggtcgtgaccggaacgctgaaaatttactactgccacgcgcatcagatcacctcgtcattacaggaaatggcggtcggtctgtcgcaaatcatctccacgcaactggaggtttcacgcgccgagcagctacgtgaaatggcaaataaggcagagcttcgcgccctgcaaagcaaaattaatccccattttctgtttaacgctctgaacgctatttcatcgtcaatccgtctgaatccggataccgctcgccagttgatctttaatctgtcgcgttatctgcgctataacattgaattaaaagacgatgagcaaatcgatatcaaaaaagagctgtatcaaattaaagactatattgccattgagcaggcccgctttggtgacaagctgacggttatctatgatattgatgaagaggtgaattgctgcattcccagcctgctgatccagccgttggtggagaacgccattgtccacggtattcagccttgcaaaggtaaaggcgttgtcaccatcagcgttgcagagtgcggaaatcgggtacgcattgcggtgcgagataccgggcacggcatcgatccaaaggtgattgagcgggtcgaagcgaatgaaatgccgggcaataaaattggcctgctgaatgtccatcatcgcgtgaagttattgtatggcgaggggctgcatatccgccgcctggagccggggacggaaattgcgttttacattcctaaccaacgcaccccagtcgcctcacaggctacgttattgctttgagccggagtgatattgtgaaagtcatcattgttgaagacgaattcctggcacaacaggaactgagctggctaattaaagagcacagccagatggagattgtcggcacctttgacgacggtctggacgtgttgaagtttttgcagcataaccgcgtcgacgccatttttctggatatcaatattccgtcgctggatggcgtgttgctggcgcaaaacatcagccagttcgcccataaaccgtttattgtgttcatcaccgcgtggaaagaacatgcggtagaagcgtttgaactggaggcgtttgactacattctcaaaccgtatcaggagtcacgtattaccgggatgctgcaaaaactggaagcggcctggcaacaacagcagaccagcagtacgcctgccgcgacggtaacgcgtgagaatgacaccattaatctggtgaaagatgagcgaataatcgtcacgccaattaacgatatctattacgccgaagcgcacgagaaaatgacctttgtctatacgcggcgtgaatcctacgtaatgccgatgaacattaccgaattttgcagcaaactgccgccgtcgcattttttccgctgccatcgctcattttgtgtcaatctgaacaaaatacgcgaaatcgaaccgtggtttaataacacctacattctgcgactgaaagatctggattttgaagtgccggtcagccgcagcaaagtgaaagaatttcgccagttaatgcatctttaatcgggaactttcatgaaagcaccaggcttgcccgccgatcaacaatttttcgccgatctgttcagcggcctggtgcttaacccgcaactactggggcgcgtctggtttgccagccagcctgcctcgttgccggtgggcagtttatgtattgattttccccgtctggatatcgtgctgcgcggcgaatacggcaatctgctggaagcaaagcagcaacgtttggtggaaggagaaatgctgtttattccggcgcgcgcggctaatttaccggtcaacaacaaaccggtgatgctgttaagcctggtgttcgctccgacctggcttgggttatcgttttacgatagccgcaccacgtcgttgttgcatcctgctcgccagatccagcttcccagcctgcaacgcggtgaaggtgaagcgatgcttaccgccctcacccatcttagccgttcgccgctggagcaaaatatcattcagccgctggtgttaagtttgctgcatctttgccgtagcgtggtgaatatgccgccgggcaattcgcagccgcgcggcgattttctctatcacagcatttgtaactgggttcaggataattatgcccagccgctcacccgcgagagcgtggcgcagttttttaatatcacgcccaatcatctgtcaaaactgtttgctcagcatggaacgatgcgttttatcgagtatgtgcgttgggtgcgaatggcgaaggcgaggatgattttgcagaaatatcatctgtcaattcatgaagtggcacagcgttgcggttttccggatagcgactatttttgtcgcgttttccggcgtcagtttggtctgacgccgggagagtacagcgcccgttttcagggctaacgtcagaaggttaattctgtttccagcagcgtcaggatactttgtgcatcttgcgcggcaaacaacgactggcggaagtttttattcaccagtttacgcgccagctgcgagaagactttcacatgattcatcccttcgttagcacccagcgtcagcatgatcaccagttcgacttcgcccatttctgactgccagccaatcggtttcgccagccgggcaatgctgatactggaatgacggatccactgagatttggtgtgcgggatcgctacgccaaaaccaacgccggtggtaacaatctcttcccgctgccagacatcttcttccagctcaaacggatgttcagtgcgcccgttaacgccgaggttgccgcacaggaactggatcgcctgctctttattgctaaaatcctgatcaacaaagatattctccagcgccagcagtgggcgaacgtcttcttccggcgtaaaggcggtgagtaacgcttcaatttcctgcgcactgcggcattcacatgcctgacgcgccagttcccgacacgcctcgctatccagttgacgaagctggcttttcaccgccggaatacgcgggctactcatactcagctcatccaggcccagcccaagcagtagcggcagataacggctttcaccgcccagttcaccgcaaatgcctacccatttgccccgctgatgcgcagtggtaactatttgctgcaacatgcgcaggaacgatggcgtaatcgggttatatagcggcgatacgcgcgggttattacgatcgaccgcatacagatactgggtcatatcgttggagccgatactgaagaaatcgacctcatcgcagaagtggtcgatgatgtagcacaccgacggaacttccaccatgatcccaagcgtaatcgtctctgcatgacgcaggccatcgcgcttaagctcaacgatcgctttttggatctcgcctttcacccataagatctgatcgaggctgtgaaccatcgggatcatcaactgggcgttgccgaaactggcggcgcgcaaaatggcccgcagttgagtgcggaacaggccagcaaattccgggtaaatacgtaccgcgcgatagccgaggaacgggttctcttcctggggaatattcagataaggaatgcttttatcgccgccgatgtccatcgtgcggaagataatcggcttgtcgcccgccgccagtagcacctgctggtaggcttcaaattgctcctgctcgtccggcgcgctgtcgcgatccatatagagcatttcggtacggaacagcccgacaccttccgcgccgttggcaaacgcgcctggcgcttccagagcggtgccgatattcgccgcaatatcaatacgcttgttatcacgggaataggccagctgcgcggcagcctgcgcctgttgtttttggcgtttatccgccagcgtctgcgcgacctgataataaccgctcaccgcgtcattcgggttaatcgccagcacgccgcactgggcgtcaagcactgcaggttgcccggcataacgggcaatcgcatccagcggcaagccactcagtaccgggatcgccgaggcacgggccagaatcagtgtatgcgaggtgcgcccggttttctccagaatcatgcccgcaagatttttcaaatcaaggctcaaaaactggcttggggttaaatcttcagccaccagaatggtcggtttttcaagcaccagcttgttgcgcggcttcagttccggccaggtgatatgcagcaactgttcgctgatatcgcgaatgtcgctaacacgttcgcgcagataatcgctggcagaggcagaaagtttggcgcaaacctgctccatattgctgatgatcgccgcccccagcccctgatgctgttctgtcatcaggcgacggatattgcctgcaaattcatcatcctgaatcagcgacaaatgggcgctgaggatagttttgctttcgccgtcacgctcacgcaattgctggttcagttgctcggcaagcgttgccaggctgtgctccagccgggtggaatcttgcgcactggcggggattgcccgataactgtcgaggctgtcgctttgtaacagggtcagcgtacccacgccgacgccgcttgccagcacattgccgtacagtaaatccgggttaaggcggcttaatgaacgcggcagcggatgcgccgtcagttctgcctgcgtaggctgaacgctgtcgctgtcgataaagcgcacctggatgtactcttccagcacgcgccgcgcctgctcttcatcgctgccgctaatgttcaggctgcaactgtcattaaatagggtgccggtgccaatcagcgccagcgagcttttcgcatctgcctttgcgttctggcgatggttaataaaagtgatttcgctttgccactggctgcactgttctttaagttcccacgccggacgagcatgtagaccgttaggcaaaggacagagaaattgaatcgttaacataaccgctccgggttaatcaggagatcatctgaaatccgtcagttgaacaaccgtctcacgcgtaagacgttgaataagggcagataaaagttgctgcatctgcaaaatgtcgcggcaatcggcaatcgatgcggcgcaatgtccatggcgggttgctggccccatcaccactgtgggcacgccggtgccggttaagtgcaccgccccgccgtccgtgccgccgttgctgaacatatctgcctgcaacggcacgccaatttctgccgccacggtttcgacccaggcggtaagttttggcggcgcaatcagcgacttgtcgcttaacaccagcatcggcccgttaccaatctggcgatggttagccgcgccataatcaaagtttttcgcccagcaggcggtatcaagcacaatggcgacgtccggcgacaccgcgcgggtggcagtttgcccgccgcgtaatcccacctcttcgctggaacttgccaccagccacacttccgcaggtagttcggcgtcgtgcagttcgcgcagtaacgtcaccagcagatagcaaccgaggcggtcatcaaaggctttccccatcactcgctggtgagggagaacctgaaaagtggtatcaaacgtgacgcgatcgccgggacgaattcccgcctgcatcacttcgtcataggagcgcgcaccaatgtccacgcgcatggcgctgacgtcattcccctgccggtcgccgtcaagcaggcctggaattttgcactcttcacgggtggtgatgcgcaccggctgcagctggcgggcagccatgcgtacgttgccaaccggcagcacatcaatcgccccttcgcgggagatgctgcgcaccataaatcccacttcgtccatatgcgcacagatcatcaccttcggacctgtcgattcattcaggcggatcagcaccgatcccagaccatcaaatcgcacttctttttgcaggcgatccgcttcttccagcaggatctgccgcacttcctgttccgaggaggcgatcgcatctgcctcgctcaacgcttttaatagcgataaatccattatgcctctcccgtgagcaacactgttttcggcatggcgtagagcacttctgcgccttgcggggtaaccagcacaacatcttcgatgcgcacgcccccttgccctggcaaataaatccccggctccacggtcagtaacatgcctggctgtagcgtcgtggtgtcccgcggtgaaaaacgcggatcttcatgaacttcaatgccgatagcgtgaccggtgttatgaccgaaatagtcgccataacctgcttctgtaatgacccggcgcgcggcatcgtcaacctgctggcagcgcacgccggggcgaatcgcggagattgctgcgagctgtgcctgcaggacaatttgatagacgttaaacagcaggtgagattcggcgctcaccccttcgccattcaccagcaaggtgcgcgtcatatcagagcagtagccctgatacagcgcaccgaaatcgagagtgacaaactcgcccgctgcaacaatcttgtcgctggctttgccgtgcggcagcgccccacgccagccactggcgacaatggtgtcaaaagaggctttttctgcgccctgctggcgcataaaccactccagttcagcggctatctcgcgctcgctcatccccgcctgaataaagcggcgaatatgctctgcaccgcgatcagcaatcccacaggcgaggcggattttctccacctcctctggcgttttgatttgccgcagcacatccggcgtggcgctaaccagtttcgcattgagttcagactgccagcggtgcgcggtttcccaactcacctgctggccctcaaaaccgagcgtttgcaactgttcatcggcaatgatttgattgacgatagtggtaagcgtgttcgtcgcgtcaagcaaatgcagctggtagccttgcgcacgggcttccacctcaacgtaatagcgcgaatccaccagaatgtgcgcactttcacggctaatcaccacataacctgatccggtggagatccccagatgcggctgtttgttctgccgtgaggagagaagcactgcatccagttgttgcgccttaagccagtcgcgcagcgaagcgagtaatgtcatctggattttccttcttacaggctatcgattaacaatttgcctttacggaacatcatcagacgcaggaacaccaccatcagcgcagttatgactgcccccagcgcgatccccgccatatagacgcccaggttagtgaccagcggccatgcccagatagcggactccgggaaccattgcactgcgcccagccagacagcggcggttgagccgacaatagcgccgaccatatacgacggaatggcggtgatggggctttccagcgcaaacggaatcgcaccctcactgatccccataaacgccaggaacatggcggtcttaccctgcggataaagttgagcgttgaacaggcgtttgccggttaaacgacggtcgataatggtcgccagccccagaccaatcggcggaataacgatagcgatagaacgagcggtgaccggtaatacgtggtcagtggtaaagctgaaggcaacaaaacctgcggctttgttgatcgggccaccaaggtcgattgctgtcgccgcggcgatccccattgcgtacatcagcgcgcccttctcacctgcggcagtcagcacagtacggataccgccgttgatccagccaccaaagggggtgatgacgtagtacatcgccagcatgacaaaaatggcggaaagaatcgggagcaaaaatgtggttttgaacgctaacaggaaatccggtaactggattttctggttcatccacttcacaaggtaaccggcaacgatagaaataatcagcgcaccaatgaaggtggacggcaccggcgaagaggtcgcccattgcatagtgctgggatcgaagttcagcagttgcgtcggctgggtagacatcaacccgccgataaaaccagccgggaacgccagtttgccaccgatagagttcgccacaaaagcagcaaacatcggaatggcaaaaccaaacaacacgccgccgaaggactgcgacagccaggcaaatttaagtaaggagaggtcgaaaccggagaatttcccgctattaagagcatccatgatgccgatctcagcaggaattttaagccagctataagcaatcagctggctgaaagcgaggatcacaccgcccataattaaggtcggcaccatgcgtgaaatccctgacatcacatgctgcgggagttcaccccagaagctggttttagaggcctgcggattcttaactgccgctgccgcaccggatgcgccaggcacaacggttgcactgcgttttttaatggccataacaattatccctgtcgaatattactgttgttcagaggcaatcatctcttcgatttctttgatgatgcccgcagcgtttttaattgcgtcctgcaaagtgatttcataaacgtcgcgtgattcgaaacgttcgttatcttccggggtaactgccacggagtggatgatgatggtcgcttcggcgatatcctgcgccgtcaggcgattctggataccgtccgcgccctgggtttcaattttcacttcataaccggcttctaccgccgcttcttccagcgcctgagcggccataaaggtgtgagccaggcccatcgggcaggcacataaggcaatcagtttcttactcatcgttaattcctcgttcagtgatagttgacgagtgaaattatgaacgtgcaaaacaaatcgccgttaccagacaaataatgcatttactggagaattaatcccgctgtacggaagtgtgacgcaggtcgaccttgtgaggggacacaaagaaaaattgaataaactgtatgatttaaaagattatcgggagagttacctcccgatataaaaggaaggatttacagaatgtgacctaaggtctggcgtaaatgtgcaccggaaccgagaaggcccggattgtcatggacgatgagatacaccggaatatcatggacatattctttaaagcgccctttatcttcaaatgcggcacggaaaccggaggctttgaagaactcaaggaagcgcggcacgataccgcccgcaataaacacgccgccaaatgtcccgagattgagcgccagattgccgccaaaacggcccataatgacgcaaaacagcgacaatgcgcggcggcaatcggtgcagctgtcagccagcgcgcgttcggtaatatcttttggcttgagattttctggcaggcggttgtcagctttcacaattgcgcgatacaaattcaccagcccagggccagaaagcacgcgctccgccgaaacatgaccaatttccgcacgcaatatttcgaggataatggcctcttcttcactattcggcgcaaaatcaacgtgaccgccttcgcctggcaagcttacccaacgcttatcgacatggaccagatgcgcaaccccaagccccgttccggcaccgtaaaccgcaataggcttaccttcgaccggttctgcgccaccaaactgaatcagatgctcttttttcagcatcgggatcgccatcgatacagcggtaaaatcgttaataatttccagatggctaaaaccgagattctttttcatttcggcaattgagaacgcccaggtatggttggtcatcgccacccagtcaccggtaattgggcaagcgatggcaatacagccgtctttcacctcgaccttatgttcttcaagataaacgcgaatgaccgcttcgaggctggggtaatcaagccctgaataggtcttagcctgcgagatttcaccactggcaatatcacacagagcaagacgtgcgttggtgccgcccacatcaccgactaatgcatactttgtcattcttcaactgctccgctaaagtcaaaataattctttctcacactgtaaatacctgggggcataacaacaacgccggaaaggcaggctccctgtaaatatcgatctgggtcacacaattactttatcgtttcagcaccaattgcagcgatgcctttttgcaagctgggcaaactaagtatctgaccccgcataaggaatagaacatgctccatccgcgagccagaaccatgttgttattatcgctccccgccgtggcaattgggattgcgtccagtcttattctgattgtggtgatgaaaatcgcctcggtattacagaatttgctctggcaacgactgccgggaactctggggatagcccaggattcacccctctggatcatcggtgtattaacgctaacgggtattgcggtggggttggttatccgtttcagccagggtcatgccggaccagaccccgcctgtgaaccgctgatcggcgcaccggttccgccctctgcgctacctggacttatcgtagcattaattctcggtcttgctggcggcgtcagcctggggccggaacatccgatcatgaccgtcaatatcgcccttgcggttgccattggcgctcgtctgttaccgcgcgtcaaccgaatggagtggactattttagcctctgccggaaccatcggcgcactgtttggcactcctgttgcggcggcgttgatattttcgcaaaccttaaatggcagtagtgaagttccgctatgggatcgtctctttgcgccgttaatggcggcagcagctggtgcacttactaccggattatttttccatcctcatttttcactgcccattgctcattacggacagatggaaatgaccgatattctcagcggtgcaattgtcgcggcgattgccatcgcagcagggatggtcgccgtatggtgcttaccacggttgcacgcgatgatgcatcaaatgaaaaatccggtgctcgtgctgggtattggcggatttattctcggtattctgggggttattggtggaccagtttcgctgtttaaagggctggatgagatgcagcagatggtggcaaatcaggctttcagcaccagcgattactttttgctggcggtaattaaacttgccgccctggtcgttgctgccgccagtggctttcgcggtgggcgaatcttcccggcagtgtttgtcggcgtggcattagggttgatgctgcatgagcacgttcccgccgtaccagcggcaataaccgtttcttgcgctattctcggcatcgtgctggtggtaacacgcgatggctggttaagtctttttatggcggcagtcgttgtacccaataccacattgctaccgctgctctgtatcgtcatgcttccggcatggctgttattagcaggtaagccgatgatgatggtcaatcgtccgaagcaacagccaccccacgataacgtttagcaaaaaatgctctcctttatgatttaagagttatggcgatgatacggggctttacctccccgtaatattgcgttaacaggccgctgacggcttcgagcgtgaaggagaataacaatgttcaggtcactgtttctggcggccgccctgatggcatttaccccgcttgcagcaaacgcaggtgaaatcaccctactgccatcaatcaaattacaaattggcgatcgcgatcattacggtaattactgggacggtggtcactggcgcgaccgtgactactggcatcgcaattatgagtggcgcaaaaaccgttggtggcgtcatgataatggctaccaccgtggctgggataagcgtaaagcgtatgagcgtggctatcgtgaaggctggcgcgatcgtgacgatcatcgcggaaaaggccggggtcatgggcaccgccattaaacgcgtccgccaatggagcacaatgcctgatgcgacgctagtgcgtcttatcaggcctacaaaccggctctttaacgcgtagggcggataaggcgtttacgccgcatccgccaatagtgccagatgcgacgctcattcaactacaatcccagcgccgtccccaccaacaaccagatattcagcgccacgaccagcaccacaatcacccagcctgtctgttttacgcgtttgctgttcaccagatcgcccatcaacttgctgtcactggtgaaaatcagcagtggaaccagcgccagagcgataccaaaacttaacagtacctgactcataaccagaatccgtgtcggatctaatcccatcagaatgacaataaatgacggcaacatggtgactgtacgacgcacccacagcgggatatgaaagcgaatgaagccctgcatcaccacctgccccgccagtgtccccaccaccgttgaagacagccccgcagcaaccaggcttaatccaaagaccgttgccgcagcgtggcttaacagcggttgcagcgtcagataagcctcatcaagatcggcaacaccagtatgaccggaaaagtggaacgccgccgcagctgtagccatcatcgccagattgacaaaaccggcaatagtcatggcgatagccacatcccatttggtggcggaataacgttgttgacgcgaaccgccatgtaaatgctgagtgagcgaggagtgcaaataaatcacatgcggcataatcgtcgcccctaacacgcctgctgccaggaagaccgcttccgaagtaggtaaactcgggatcaccattcctttacccagctgcgccaggttaggctgggagaaaatcaactcgacaatgtaagccgcggcaacaaacaacagtaacccgccaatcactttctccagcggtttttgcccgcgacgttgcagcattaaaatcaggaaagtcgcgatccccgtcagcaccgcgccctgcaacaacgaaacaccaagaatgagtttaaaaccgatcgccgcaccaataaattccgccaggtcggttgccatcgcaataatttctgcctgaacccaatagaaccacactacgggacgcggatagtgatcgcgaatctgctccgccagatttttaccggtggcaatccctagtttggcagagaggatctgaatcagcatcgccatcaggttggcccaaacgacaacccacagtagctgatagccgaagctagcacccgcctgaatattggtcgcaaagttaccgggatcgatataaccaatcgccgcaatgaacgcaggtcccattaatgcgagcctcatcttgcgcgccgcccgtccgctgctactctcaacgcgatagttcgtcatcttgtgcctctaaaacatagcctttgctatgtttcatgctatgccaaacgagaatgattatcaaattcatttaaatggattgtggtgatttctctgatagaccaggattatgactacgaaaagattgatgacttgaatgttatggttatgtttaatgttagcacatttacataactttcagcttccatacacaacatagcagaaatgtatgacagatcactatttttgaagcctgtcacaggacgtcattatagtgtgtgtcagatctcgttttccttaaccatgttacatagaatgtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtttaggcttcgtgaaaggcttctccgaaatgttcgaaaaactgctcggatttgccaacgaagggactaacttcgtctttggtagcatgaatgatcaaggcctggcattcttcttcctgaaagtgctgtgcccaatcgtctttatctctgcactgatcggtattctccagcacattcgcgtgttgccggtgatcatccgcgcaattggtttcctgctctccaaagtcaacggcatgggcaaactggaatcctttaacgccgtcagctccctgattctgggtcagtctgaaaactttattgcctataaagatatcctcggcaaaatctcccgtaatcgtatgtacaccatggctgccacggcaatgtccaccgtgtcgatgtccatcgttggtgcatacatgaccatgctggaaccgaaatacgtcgttgctgcgctggtactgaacatgttcagcacctttatcgtgctgtcgctgatcaatccttaccgtgttgatgccagtgaagaaaacatccagatgtccaacctgcacgaaggtcagagcttcttcgaaatgctgggtgaatacattctggcaggtttcaaagttgccattatcgttgccgcgatgctgattggctttatcgccctgatcgccgcgctgaacgcactgtttgccaccgttactggctggtttggctacagcatctccttccagggcatcctgggctacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgctgaaggcatcatctctgtgttcctggtttccttcgctaacttctcttcaatcgggattatcgcaggtgcagttaaaggcctgaatgaagagcaaggtaacgtggtttctcgcttcggtctgaagctggtttacggctctaccctggtgagtgtgctgtctgcgtcaatcgcagcactggtgctgtaagaccatacataaaaaagccggggataattcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggataattccccggtttttttacgcctgttaatcagctaatggctgcgggcgaccaatcaaatacccttgcagatattgcaccccgagcttatgcaatagcgcctgctgctgttgcgtctcgacaaactccgcgaccacactcaatgacttcgctttcgccagatcggtaattgatctcacaatcatcgcatccagcgtgttcgtgacaatatctttcacaaagacgccatcaattttgatgatatcagcctgcaaacgctttaaccgttcgtagttggcatatccggtgccaaagtcatcaatcgcaatccggaaaccaaacttatgcagctgctcgatgttgtacatgctgctttctgcgttagaaaacgcctgctcctcggtgatctcaagaatgaccgcctgcggggagatgtgataacgcttaaacagacgaataatccgcccggcaatattcttttgcagcagcgtgagcggcattaaattgactgaaaagcgcggtccttttttgtcgcaagggtgtgttgccagccacttcaacaaggattccagcacttgcaaatcaaaacgcgcgctaaggttaaactgagcaataaggggcagaaacttatccggggtcataatgccgccgtcatatttcagtcgcgcgaggatctcatcataaccttcaccctctttgttgcgaattggctgggcgtagagcagcaaatcaccctgatctaacgccgtgcgaatggtattcagcaatagcacctgtttagtggtctgcccggaaaccatctcctctctgctatccagcgccagcacatgatgatgtgcgcaggattgctccgccagccagcttaactgccccaacaagggttgcagggtttcctgatttccatcaaaacgcccccaggcagcaccatagcccatatccagcccggtattgttccagtgaatttgccgactattcaggatgttaaccatatgctggagtcgcccttccgtttccggcccgctcagcactaacagcagttcactacccggcaattgatacaacttttcgttttcctgcatcaacggcagcagcgtacggcaaattgagcggatacagtgaacgcgcatcattaagccgtaatgacgactcataaactcaagattatcaatgcgcaggcagcaaaaactcttgcccgcctcttgctccggcgcttgttccaacgcacgaaagttgggtaggagcgttaacggatctgtcagcgcctgcaaatgccagcggcgattaagccattcactgcgatgataaatgcgcaccatatagagcaggcaaacgctaaaggaaatcagcaccgcaagaataaatgccagcgaatattcggtttccaccccttgcaaaaagttctggttgtaattcagaaggcaaagcgttgaaacagcccaggtgagatttaaaaacggatagcgaagcttaccgaccccgagggtaaagatgatgaagaaaacgggtaccaggtaaccggcaataaagtcgttttcataaggtgtgcacaacagaagtagcagcacgcttaacgctgccagccagcttaaggtaaatgcgcgtttctctttgcccaacgacggagcgatatccctgcgccacaatatctgcgcaaagtggggacttacaatcatgcgagtgagatagtagaaaagcatgttgtaaatcagcacagcggtgaaaaggcttagcaaatcaacgaccgtgaaaatggcatccgcatcgccgaaaaaggtggatatctttagcgggaaatcaaagaagctccccacaagatacatgctgcatttgatgccgatcggcgtcaccaaaccaagccagaacagacgttgccagacatatcggctggtcaatccataacgccaacgcgtccccagctgccagcgtaatattgcgcaggcacacaacacgacaaacgtctggctaccgagcatgaccgcagtctgtaaaaaagagagatgaaagttccacagattggtgcaaaacatcccgcataaaacgggaacgacaccgcgccagccaaagataaacaagattgacagcattacgcacagtggcatccacgccagaaagatataactggaatggataatggcaagtggcgaaataaaacgggatagctgaataagtaccacggtgagcgtaaacgctagtgtgaatatcttgatattttttatcaggttatgctccacaaacatgagtacactactctcactgatcggggttttcaggcacacaaataataagtttattcgcatcgcgaagcaaacagggggccagcctgttgccgatttttcatccaatgatgctttcaccaggcggcactaacccggacgtagactgtattacaaaagcggcaaaaagcagagacaaaaaacccccgctttgcagcgagggttggaaatttggtggagctaagcgggatcgaaccgctgacctcttgcatgccatgcaagcgctctcccagctgagctatagccccacgatgcgtttacgtaccaagtttgctgggtgcaaaatttggtggagctaagcgggatcgaaccgctgacctcttgcatgccatgcaagcgctctcccagctgagctatagccccgtcacgtaaagcttgtcgagttgacgggcggcatcatatgaattccgcccgaatgtgtcaacggcaaattgcaacgtgtagtttcaatcgctgaaaaatcaggcaaatgaacaattttggaaaaccgctcgcattcagtagttattcatgtcacggtttcctgtaaagtggtgttataaaatgaactactaatagacccacatacattcagggaattgttatgttcaaggagaggatgacaccagatgaacttgccagactgaccggctatagccgccagaccattaataaatgggtacgcaaggaaggctggacaacgtcaccaaaacctggcgtccagggtggcaaagcccgactggttcacgtcaatgaacaggttcgtgaatatattcgcaatgctgaacgtccagaaggtcagggagaagcgcctgccctttctggtgatgcgccgcttgaagtattgctggtgacactggcgaaagagatgacgccagttgaacaaaaacagtttacatccttgcttctgcgggaagggattatcggattgttacaacgcttagggattcgcgatagcaaataatatgaaaagattacgcaataaaatgaccaccgaagaactggctgaatgcctcggtgtggctaaacaaactgttaaccgttggatcagagaaaaaggctggaaaacggaaaaatttcccggcgtgaaaggcggtcgtgccagacttattctggtcgatacgcaagtttgcgagtttattcagaacacgccagccttccataacacaccaatgttgatggaagctgaagagagaattgctgaatacgctcctggagcacgcgccccggcgtatcgacaaatcatcaacgcgatagataatatgacagacattgagcaggaaaaagtcgcgcaatttttgtcacgtgaaggaattcgcaatttcctcgcccgtctcgatattgacgaatcagcataaataaaaaacggcaggatattatctcctgccgtttatctttttacacgctaattactgctgattttcgcgttcagcaataaaatccagcgctttgttgatacgctcgatactgcgggtcttaccaattgcgtgaacggtaacatccagtgctggagactgccccgcaccggttacggcgacacgcagcggcataccaactttacccatacccacttccagctcatccgccgtcgcctgaatagcgtgatgaacgttttcagcggtccagtcagtaatcgcggccagtttgtcacgaaccacttccagcggctgacgcgctaccggacgcagatgttttttcgcggcgtcggcatcgaactcagcaaaatcttcgtagaaataacggcagctctgtgccatctctttcagcgtcttgcagcgttcgcccagcagtttcaccagatcagccagctgcgggccgttacgggtatcgatattttcctgctcaatgtgccactgtaagtgagtagcaacatactccggcggcagcgcgttaatgtagtgatggttcagccacagcagcttgtcggtgttgaacgcactggcagatttgctgacggcattcaaagtgaagtatttgatcatctcttcacgagtgaagatttcctgatcgccgtgggaccagcccagacgcaccagatagttcagcagtgcttctggcaaataaccgtcatcacgatactgcattacgctgactgccccgtgacgtttggacagttttttaccgtcatcgccattgatcatagaaacgtgcgcgtaaaccggcaccggcgctttcagggccttaagaatgttgatctggcgtggcgtgttgttgatatggtcttcgccacggataacgtgggtgatttccatatcccagtcatcgacaaccacacagaagttataggttggggaaccatcggtacggcggataataagatcgtccagttcctggttgctgaactcgatcggaccacggatctgatcgtcaaaaacaacagaaccttcctgcgggttagcaaaacgtacaacacacggttcatcatcagcatgatgctcatggctgtggcggcagcgaccgtcataacgcggcttctcacctttcgccatttgctcttcgcgcagcgcttccaggcgctctttagagcaatagcatttataagcagtgccctcttccagcatctgatcgatcaccgcgttgtagcgatcaaaacgtttggtctggtagtacggaccttcatcccactccaggctcagccagttcatgccatccataatggcttcgatagcttccggcgtggaacgctcaagatcggtgtcttcaatacgcagcacgaactcaccgccgtggttacgtgcaaaaagccaggagtaaagagcagtacgcgcgccgccaacgtgcagatagcctgttgggcttggcgcgaagcgagttttgattttcatgaaatggccttacgtttagaaagatgccgacaaccggcaaatcctggaaaaattaagtgggcgatattctatcactcccgcctgattcctcaatgtagttcgggtttctaccttacgcattattgttttcgttgacaaattgcgcaacacggtctgttttgcgatcatcttgcttaaatttacgacgaacgaacaatttctttagaaaatgcgttgactcattttgaactctccctataatgcgactccacacagcgggggtgattagctcagctgggagagcacctcccttacaaggagggggtcggcggttcgatcccgtcatcacccaccaactactttatgtagtctccgccgtgtagcaagaaattgagaagtgggtgattagctcagctgggagagcacctcccttacaaggagggggtcggcggttcgatcccgtcatcacccaccactttctcgccagctaaatttcttgtaaaaatgtgaagtaccgaagtgggtgattagctcagctgggagagcacctcccttacaaggagggggtcggcggttcgatcccgtcatcacccaccacttcgggtcgttagctcagttggtagagcagttgacttttaatcaattggtcgcaggttcgaatcctgcacgacccaccaatgtaaaaaagcgccctaaaggcgcttttttactatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctatctgcgatttgcgaaattgcctgatgcgcttcacttagcagactactatttccggcaattcctgtctcctcacctactgtgtcaatgcagccaacagcttaaccatcgcgggcgtcacctgctgtgtttcataaacaatatataaatctgcagggatgcgctgtttgagcggacggaaaatgacacctggccagttcatttgtgcgtagctgtccgctatcaatgtgataccaatgcccatactgaccatagcgagtaccgtttgcggttcattaacttcgcgaataacaaccggtgaaaatcccacctgctggcaaactcgctgcaaaaaatcccagtcagtgtaaacgggcggcattgtaacaaaatactcgtcacgtagcgcttccagcgggacggtggaaaatgatgagagatgatgctcttcaggcatcgccaccagaaacgccgattcatgcaaccgtaagctggtaaaaccagtcggtggttctgtcgccattcgccagatcccggcatcaagttcgcggcgttccagcaaggccatttgcatcgcgggcatcttttcgcgaaaaagaacgtcaacgttaggattttccctgaggaatcgccgcataaccgggcgcatccgtccccacattgccgttcccactacgccgagttcaatccgccctgcttctccccgacctatttgttcaatccgagccaatacattattagcattcaccagcaatcgacgcgattcttccatcaagattttgcccgcgtgtgtcagtacgacgctgcgcgaatggcgaataaaaagctgcgtgccgagttgattttccagctctttaatatgaatgctgagcggaggctgagacatatttaaacgcgctgctgcgcggccaaaatgcaactcttccgctacggcaagaaaataacggagcaacttaagatctgttctgtatacgcgttccataattaagtgctccatataataaatacatcgtattaaattatcatggcataaagtatttcaccaccagatatccgacatacataaacacaatggataatatacccggtaatacatttggtacaggaataggcaagcgcacgattgtaaacaaagcaccaataccaaaaccaacgccggaagaaaataaaatatctttcactaattaacctttatcataaaagcagctctgaagagcagagccgcgaatccttttaatgagtcaccgctcgatgctttatcttttcagggtcatgattatatttaaacccaaagaaaaatatcactgcgagaaaaagagcatatcctgcaaacaccagccagatagtttgccagtcttttacgccatccaccgaaaagtaatctactgccatgccactcagaatcgagccaacccatgcgccgacaccatttaccatggtcataaagagcccctgcgcgctggcacgaatgctggaatcaacttcctgttcgacaaataccgaaccagaaatattgaagaaatcgaatgcacagccataaacaatcatcgacagcagcagcaaaataaatccggttgttgacggatcgccataggcgaagaagccaaagcgcagcgtccaggccaccatactcatcagcatgacggttttaatgccaaatcgctttaaaaagaatgggatagtcagtataaagcccacttctgccatctgtgaaactgacagtaaaatggagggatatttcaccacaaaactgtcagcaaactccgggttacgggcgaaatcatgtaggaacggattaccaaaaacgttggtaatttgcagtaccgcacccagcatcatggcaaagaggaaaaagatggccatgcgtggatttttaaacagcacgaaggcatccagacccagcttgctggcaagcgatgtggtcgcttttttctccgcaaccggaatcttcggcaaagtcagcgcataagccgacagcagcaatgacgcaccggacgcgatatacagctgcagactactcaattccagatgcagcaggcttactgcccacatcgcgacaatgaaccccaccgtaccaaaaacgcgaatgggcgggaaagcggtcaccgggtcaagccctgcctgggcaagacaggaataagagacgctgttcgataacgcaatagtcggcataaacgccatcgcattgactaacatcacccaaaacatcatatccggatcagttacggatgccgcataaaaaagtacgcccgcacacaccaggtgacacagcatgtatgcacgttctgcgcgcagccatttgtctgcgatgatccccattataccaggcataataatcgcggcgatccctttggaactgtaaaccatgccaacattagcgccggtgaaatgaagagtattaatcatgtaagagccgagggtaaccagccagctcccccagataaaatattgcaaaaaggacattacctttaagcgcatcgcgatgctcataatcgtttccttgtcgcatcatttggcctcacccgcgaggccgtttcttattgtttttctcaggcaattttgcgcagaaagccacaaataaggttgatgaagttctgcttagagagctccgcagccgccagcgtttgcgcatgtgacaatttcacatcgcttaaaccttccgccatattggtaatcgcagagaccgcaacgactttaaggtcgcaatggcgagctgaaataacctcaggcaccacagacataccaacaacatccccaccaataatttgcatcatgcgaatttccgccgcagtctcgaaattcggccccggatacgagacgaacacgccctccgtcagagggaaaccctcttctttcgccactttttgtaacagtgcgcggtattccgcatcgtaggcatttgccagtgagaagaagcgctctccaaaacgatcatcgttaagacccaccatcggcgtaccgggcatggtgttgatatgatctttcaatgcgaccaggctgcctgcccccacttccggacgcagcgagcctgccgcattggtgcagaacagtagctcgcagcccagcagcttaaaggtacgaattgcgtcagtcataatggtcattccacgaccttcgtagaaatgtccgcgacctttcatacataccaccggtacgccctggagatggcccagcactaactcccccgcatgaccatgtaccgtacttaccgggaagcccggcagcttttcgtaggaaattgcgacagcgttctcaatctgatcggccagcgcgccgagcccggaacctaaaataaaggccactcgtggcgtgaaatcaggtttataagtcttgataatatctatgcaaaacagcgggttatgagaaaattgaacctgagacatacatatcctttttctgtagggtggaatctaacgcctttttatagcgaggttgtcccggctcttaccaatacacttttctcacgcattcaatagcgattcgatatcgatggatttatatcttttctctattaatccacggtaaaaactgtattggcgatattaattcctttgcattaacaatatgtcgtttttagcaaaccactttattaagcaatctactaataacgatcggcatagggaattatgctatgaaaaaacatcttttaactctgacactttcctctatattagcgatacctgttgtatctcatgcagaatttaaaggcggttttgcagatatcggcgtgcattatctggactggaccagccggactaccgaaaaatcgtcgaccaaatcacacaaagatgattttggttatcttgaatttgaaggtggcgctaactttagttggggagaaatgtacgggttcttcgactgggaaaacttctataacggtcgccataataaaccaggtagcgagcagcgttatacctttaaaaataccaaccgtatttacctgggtgacaccggatttaatctctacttgcatgcgtatggcacctacggttctgcgaatcgcgtgaatttccacgacgatatgttcctgtacggtatcggctacaatttcaccggcagcggttggtggttcaaaccgttctttgctaagcgttatacagatcaaacctattacactggcgacaacggctatgtcgccggctgggttgcaggttacaactttatgctgggcagcgagaaattcactcttaccaactggaacgagtacgagtttgaccgtgacgctacctatgcagcgggtaatggcggtaaagaagggctgaatggcgcagttgcactgtggtggaatgcaacatcacacattactacggggattcagtatcgatatgcggatgacaaactgggcgaagatttttaccaggatgcgataatctactccatcaaatttaacttctgattgattactgccggggctcccggcagtatgaattcactctatatctgatacaacggatccccttcccgcccagccattagcgcattgccctggtctcgtaccacgtcccataaagcttcagcggcggtggaaagtgaacggttcttcctgcgcaccagcatcaactggcgttcaacaaccggcgtaatgcgctttaccaccagtgggctaccttcaggcaatggtagcgccagtgcgggaagaatactgatgccgatgcctgcggctaccatcgggaacagcgtcgccggatgtccaatctcctgcacaatattcgcctgaataccattgcgcgccagcgctgcgtcaatcagcggtcggctgcctgacgcgtaatcctgcaacaccaatttcgctccctgtaatgcctgccagggtacataatcttccacggccaaagcgctatcgcgatggcaaagcagaaagaaaggctcggaaagaatcgcttcacattgcagatcgcccactgggcctggatcgatgacgatgccaaaatcgacatctccctggcgaatactttccattacccactgctgcggacgatcgtgcaggacaaactgaatatctggatagcggcgatggctttcagcaatgcattgcggaataagatgcgcggaaatggtctggctggcagcgacccgaacttttccgctcagttgttgccccatacgcccggtatcgcgcaacgtgctgttcagttcatccagcagtcgctcaagacgcaaagccagctgctgccctgcatctgtaagcaccacttcacgcgtggttctgtccagcaggcgaacaccagtatgattttccagttccttcacactgtgactcactgccgactggctcaggccgatacgctctcctgcacgactaaaacttttctcctgcgctactgtgacgaaaacctttaattgttttaaagaataattcatctgttttcttcatgaatggatgcaataaatcaattttatttctcaaactggaagaagcacaatagaaccatcgatcatctggagtctttatgaaactttttcgtatcctcgatcctttcaccttaaccctgatcacggtggtgttgctggcctctttctttccggccagaggcgatttcgtccccttctttgaaaatctgaccaccgcagctattgccctgctgttctttatgcacggcgcgaagttgtcgcgtgaggcgattattgctggcggtggtcactggcgactgcatttgtgggtaatgtgcagcaccttcgtgctgtttccgattctgggtgtactgtttgcctggtggaaaccggtaaatgtcgacccgatgctctactccggttttctctacttgtgcattctcccggctaccgtgcagtctgcaatcgccttcacgtcaatggcgggcggtaacgtcgcggcagcggtttgttctgcgtcggcatccagcctgctggggattttcctttcaccattgctggttggtctggtgatgaatgttcacggtgcagggggcagccttgagcaggtcggtaaaattatgctgcaactgctgctgccgtttgtgttggggcatctttcccggccgtggattggtgactgggtgtcgcgcaataaaaaatggattgcgaaaactgaccagacgtccattctgttggtggtttatacagcgttcagcgaagccgtcgttaatggtatctggcataaagttggctggggatcattgctgtttatcgtggtggtcagctgcgttcttctggctatcgtgattgtagttaacgtctttatggcacgccgactgagcttcaataaggcagatgaaattactatcgtcttttgtggttcgaaaaagagtctggcaaatggcatcccgatggcaaacattctgttccccacatcggtgatcggtatgatggtgctgcccctgatgattttccatcagatccaattgatggtctgtgcggtgctggcgcgtcgatacaaacgccagaccgaacagttacaggcgcagcaggaaagcagcgccgataaagcttaaagcggacgcttcaggggctggaccagttgcgtcagcccctcggttttaatcagcagcgtgatttgcattagctcaccgagcttccctgccgggaactcatctttgcgggcaaaccacagcagatactcctccggcaggtcgattaagcgacgccctttgtatttgccaaacggcattatcgtattggctatttcaatcagctgctctttttccatctcagctacccagcaaacgcagcatttccgcttcgtcgatgacttcaatgcccagttcctgcgccttcgccagtttagatcctgcagcttcacccgctatcaccagatcggttttcttcgacacgctgcccgcgactttcgcgcccagttcgaccagtcgagctttagcgtcatcacgcgacatctggcttaagctgcccgtaagcaccacggttttaccagcaaacgggctgtcaatctcttccgcgttgataacgatcggcgcaggccagtgaacaccttccgccaacagctcgctgatgacattgcggttgctttcttcggcaaagaagttgtgaacgtgggatgcaacgacaatgccaacatcaggcaccttttgcagctcttcaatcgaagcggcttccagcgcttccagcgtgccgaaatatgccgccagacctgctgcggtggcctcgccgacttcacggatgccaagtgcatagaggaagcgagcaaaggtggtttctttcgctttttccagcgcgttaaccacgttttgtgccgattttggccccatacgctccagtccggtcagtttgcctgcggtgagtttgaacagatctgccggagtatggacatattctttttcaaccagctgatcgatgattttgtcgcccattccgtcaacatccatcgcacggcgggaaacaaagtgtttcagcgactctttacgctgcgcaccgcaaatcaggccaccggtacagcgggcaaccgcttcaccttccacacgctcaacgtcagaaccacataccggacaatgcgtcgggaatacaacctcacgggtatcttccgggcgttcagaaagcacgacgttaaccacctgcgggatcacgtcgccagcgcggcgaatcaccactttatcgccaatgcgtaaaccaagacgttcgatttcatccgcattgtgtaaggttgcgttactcaccagcacgcctgcaacatggacaggttccagacgcgcaacaggcgtaatcgcgccagtacgcccaacctgaaactcgacgtcacgcacaaaggtcatctgctcctgcgccgggaatttaaacgctaccgcccagcgcggggcacgcgcgacaaagccaagctgctcctgctgtgccagtgagttgaccttaatcaccacgccgtcgatatcaaagcccagcgtcgggcggtcttcttccactttgtgatagaacgccagcacttcttccgccgattcacaaagcgttacccgatcgctgaccggcaacccccactttttaaattgcagtaaacggccaagatgagtatccggcagctcgccaccttccagaacaccaacgccatagcagaaaaaagtgagcggtcgcttcgctgtaatacgcggatcaagctgacgcagtgaaccagctgccgcattacgtgggttagcaaacactttcccgcccgtgcgtcgcgcatcttcgttaatcttttcgaaccccgcctgcggcaggaacacttcaccacgcacttccagacgcgccgggatattctctccgtgcagcttcagcggaatggcgcgaatagtacgcacattagacgtgatatcttccccggtggtgccatcgccacgggtcgcggcactgactaaaacgccattttcatacagaatactgacggcaagaccatccagcttcagctcacagcaccaggtgactttctcgttgtttttcagacggtcctgcacacgtttgttgaaagcaagaaagctttcttcatcaaaaacgttatccagtgacagcattggtacttcatggcgtatctggctgaaagccgccagcggcgcagcgcctacacgttgagtaggcgaatcaggcgtaatcagttctggatgtttggtttccagctcgcgcagttcgcgcatcagcctgtcgtattcagcgtcgggaatttccggcgcatccatcacatgataaagatattcatgatggcgaagcgtcgttcgcagttctgtcagttgttgttcgattgattccatatcgcaccatcaatgctaaaaacccccgacaagcgggggttcgaagaggagttaatttgccttaagtgtatcaggcgttggcgtctttgacttcgcggatgatgtcctggtactcgcgcaatttctgcggagtcatcatacggcgctgatcgtcaagcacgacaccgcccacttcatcggcaatatgctgcgcagattgcagcatcagcttgaagttctgcagctcgtcaccgtaagacggtacctgcataaagatagtgacacccggagtagtgaaatccttcatttcaggatcaaaggttcccggtttcaccatattcgccaggctgaataacgccgggccgctgccatccgggctaagatgacgatggtaaatattcatatcgccaaaaatgaagcccgcttgttgaatgctgttaagaagcagttcaccgtttagctcgctaccgtgatgcgccgcgacgttcatgataatcaccgcttctttgcgcttcggtttatccataactggagcaggttccgctacaggctcaggctgtggtgccgctacgggttctgcaggctggaaagcctgttgtgccggttgcggtgctgaatgcacaggctgcggcgctggcgcgacctgtggcgaaactggctgctgcaacggctgttcaggctgcggctgataggcaggctgctgcaccggctgcgctggatgcggagcatgttgcggcggtacctgcgcttcaggcggctgctggaccggttgacgcggctgcgcagacgcataaggcggttggtactggtgttgcggcgacggacgagcagcctcatgctcctgagcgttagccggggcatgattcacgcggtgaacacgaacctcaccaacgccctcatcatcttcgacatcctcgtcataagaatcgtcgtcacgttttgacttcattcgttttaatggccgatcgcggaacatagaagatcgttctttacggctggtccagaaaccatgtaccagtaaagcgattatggcgatcgcgccaacaatgattaatatcagacgcaaatcctgcatcattatattctctgttgttctaacaccttgccaccacggcaaacatttactcactaagagtatttgccgattacctcaagtgcaagtgcactattaactttcacagcacaaagatagatgaaatcgtgctttttgctgttttttcgaacatatcctaactgtccattgcgcaattacccggtaaaatacgcagaattttcctgggattggtcaaaaggagctcatcctgattatggtttcatcattcacatctgccccacgcagcggtttttactattttgcgcaaggctggaagctcgtctcgcaacctgggattcggcgtttcgttattttaccgctgctggtcaatattttgttgatggggggcgcattctggtggctctttacacagctcgatgtctggatcccgactctcatgagttacgttccggactggctacaatggctgagttatctgttgtggcctctggctgtcatctctgtgctgttagtgtttggctatttcttctccacgattgctaactggattgccgctccgtttaacggtttattggctgaacaactggaagcacgattgactggcgctacaccgccagataccgggattttcggtatcatgaaagatgtgccgcgaatcatgaaacgcgaatggcaaaaatttgcctggtatctgccgcgcgcaattgtattactaattctttacttcatccctggtattgggcaaaccgtcgcgccggtactgtggttcctgtttagcgcctggatgttagccatccagtattgcgattaccccttcgataaccacaaagtgccgtttaaagagatgcgcaccgccctgcgcacacgcaaaatcaccaatatgcagtttggtgctttaaccagcctgtttacgatgatcccgctgcttaatctgttcatcatgcccgttgccgtttgtggcgcgacggcgatgtgggtcgattgctatcgcgataaacacgcgatgtggcggtaacaatctaccggttattttgtaaaccgtttgtgtgaaacaggggtggcttatgccgccccttattccatcttgcatgtcattatttcccttctgtatatagatatgctaaatccttacttccgcatattctctgagcgggtatgctacctgttgtatcccaatttcatacagttaaggacaggccatgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccgaccagcggtaataccgggattgcactggcctatgtagctgccgctcgcggttacaaactcaccctgaccatgccagaaaccatgagtattgaacgccgcaagctgctgaaagcgttaggtgcaaacctggtgctgacggaaggtgctaaaggcatgaaaggcgcaatccaaaaagcagaagaaattgtcgccagcaatccagagaaatacctgctgctgcaacaattcagcaatccggcaaaccctgaaattcacgaaaagaccaccggtccggagatatgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggcccgcataaaattcagggtattggcgctggttttatcccggctaacctcgatctcaagctggtcgataaagtcattggcatcaccaatgaagaagcgatttctaccgcgcgtcgtctgatggaagaagaaggtattcttgcaggtatctcttctggagcagctgttgccgcggcgttgaaactacaagaagatgaaagctttaccaacaagaatattgtggttattctaccatcatcgggtgagcgttatttaagcaccgcattgtttgccgatctcttcactgagaaagaattgcaacagtaatgccagcttgttaaaaatgcgtaaaaaagcacctttttaggtgcttttttgtggcctgcttcaaactttcgcccctcctggcattgattcagcctgtcggaactggtatttaaccagactaattattttgatgcgcgaaattaatcgttacaggaaaagccaaagctgaatcgattttatgatttggttcaattcttcctttagcggcataatgtttaatgacgtacgaaacgtcagcggtcaacacccgccagcaatggactgtattgcgctcttcgtgcgtcgcgtctgttaaaaactggcgctaacaatacaggctaaagtcgaaccgccaggctagactttagttccacaacactaaacctataagttggggaaatacaatgttccagcaagaagttaccattaccgctccgaacggtctgcacacccgccctgctgcccagtttgtaaaagaagctaagggcttcacttctgaaattactgtgacttccaacggcaaaagcgccagcgcgaaaagcctgtttaaactgcagactctgggcctgactcaaggtaccgttgtgactatctccgcagaaggcgaagacgagcagaaagcggttgaacatctggttaaactgatggcggaactcgagtaatttcccgggttcttttaaaaatcagtcacaagtaaggtagggttatgatttcaggcattttagcatccccgggtatcgctttcggtaaagctctgcttctgaaagaagacgaaattgtcattgaccggaaaaaaatttctgccgaccaggttgatcaggaagttgaacgttttctgagcggtcgtgccaaggcatcagcccagctggaaacgatcaaaacgaaagctggtgaaacgttcggtgaagaaaaagaagccatctttgaagggcatattatgctgctcgaagatgaggagctggagcaggaaatcatagccctgattaaagataagcacatgacagctgacgcagctgctcatgaagttatcgaaggtcaggcttctgccctggaagagctggatgatgaatacctgaaagaacgtgcggctgacgtacgtgatatcggtaagcgcctgctgcgcaacatcctgggcctgaagattatcgacctgagcgccattcaggatgaagtcattctggttgccgctgacctgacgccgtccgaaaccgcacagctgaacctgaagaaggtgctgggtttcatcaccgacgcgggtggccgtacttcccacacctctatcatggcgcgttctctggaactacctgctatcgtgggtaccggtagcgtcacctctcaggtgaaaaatgacgactatctgattctggatgccgtaaataatcaggtttacgtcaatccaaccaacgaagttattgataaaatgcgcgctgttcaggagcaagtggcttctgaaaaagcagagcttgctaaactgaaagatctgccagctattacgctggacggtcaccaggtagaagtatgcgctaacattggtacggttcgtgacgttgaaggtgcagagcgtaacggcgctgaaggcgttggtctgtatcgtactgagttcctgttcatggaccgcgacgcactgcccactgaagaagaacagtttgctgcttacaaagcagtggctgaagcgtgtggctcgcaagcggttatcgttcgtaccatggacatcggcggcgacaaagagctgccatacatgaacttcccgaaagaagagaacccgttcctcggctggcgcgctatccgtatcgcgatggatcgtagagagatcctgcgcgatcagctccgcgctatcctgcgtgcctcggctttcggtaaattgcgcattatgttcccgatgatcatctctgttgaagaagtgcgtgcactgcgcaaagagatcgaaatctacaaacaggaactgcgcgacgaaggtaaagcgtttgacgagtcaattgaaatcggcgtaatggtggaaacaccggctgccgcaacaattgcacgtcatttagccaaagaagttgatttctttagtatcggcaccaatgatttaacgcagtacactctggcagttgaccgtggtaatgatatgatttcacacctttaccagccaatgtcaccgtccgtgctgaacttgatcaagcaagttattgatgcttctcatgctgaaggcaaatggactggcatgtgtggtgagcttgctggcgatgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaatccacgagatgcggcccaatttactgcttaggagaagatcatgggtttgttcgataaactgaaatctctggtttccgacgacaagaaggataccggaactattgagatcattgctccgctctctggcgagatcgtcaatatcgaagacgtgccggatgtcgtttttgcggaaaaaatcgttggtgatggtattgctatcaaaccaacgggtaacaaaatggtcgcgccagtagacggcaccattggtaaaatctttgaaaccaaccacgcattctctatcgaatctgatagcggcgttgaactgttcgtccacttcggtatcgacaccgttgaactgaaaggcgaaggcttcaagcgtattgctgaagaaggtcagcgcgtgaaagttggcgatactgtcattgaatttgatctgccgctgctggaagagaaagccaagtctaccctgactccggttgttatctccaacatggacgaaatcaaagaactgatcaaactgtccggtagcgtaaccgtgggtgaaaccccggttatccgcatcaagaagtaattcttgccgcagtgaaaaatggcgcccatcggcgccatttttttatgcttccgccagcggcggcaaaatcaattcatcgctctcatgctgctgggtgtagcgcatcacttccagtacgcgcaaccccgctcggtgcactgcatcggttaacgccttccctttcagcaagccactgatgagctgagcacaaaacaggtcgccagtccctttcaggtcggtttttacccgtgaatgggaaatgacattcacgctgtcggcagtgaccaccacaacctgcatctcctgattttcttcattaccggaggcgctggtaaccaccacccattttaatgtgtctgaaagcagactttttgcggcagcaatggcactgtcgagatcgcggcaatttttaccggtcaggatttccaactcaaagatattgggggtaattccctgcgccagcggcagtaaatattgtcgatacgcttcgggaaggtcaggtttgacataaattccgctatcaatatcgccaatcaccggatcgaccatgatcaataggtcaggatggtctttgcgtagcgcagtcagccactcggcaaggattttgatttgcgatgccgttcccatatagcccgtggttacagcacgaagttggcgcagcgcatcacgctcctgaagcgcacgcaaatagccgctaaaccattcgtccggaatcgcaccaccgtagaaagtgtcataatgcggcgtattgctcagcaataccgtcggcacggcaaagacattcaggccgttctgtttgatagcaggcacggcaatgctgttgcccacgctgccgtaaaccacctgcgactgcacggcgacgatatccgcctgcagtgccctactcttatcgttaaacaacaacaaactactcatttaattttttctccttgccgatgatcctcatcgtaatccaaccgaaactttacctgattctggcagtcaaatcggctatcacaaaacaaggataaggtaattcaatgaagaaaatcatttgtctggtcattacactactaatgacactccccgtttacgcgaagttaactgcccatgaagaagcccgcatcaacgccatgctggagggattagcacagaaaaaggatttgatatttgtgcgcaacggtgatgaacatacctgctatgaagcggtttctcatctgcgtctgaagctcggcaatacccgtaaccgcattgacactgccgagcagtttattgataaggttgcttcgtcgtcatcgattactgggaagccgtatattgtgaagatccccggtaagagcgatgagaacgcacagccttttttacatgcgttaattgcgcagacggataaaacggtgcctgcggaaggaaattaatccgctttgggaaggcatttacaggaggtaacatgaaaaaacgctttatttatcacgatgaaaaatcgaataaattttggtggatagattacgaaggggatagtttagctgtcaactatggcaaggtaggtagtattggtaaattccagacaaaagagttcgataatgaagaacagtgtctgaaagaagccagtaaattgattgccgcaaaaatgaagaaaggctatcaagaagatccaaagtttaacttcatggatcgctactattttgatgatgaagaaattgggttacatgttaaaacgtcacacccaaacttccagtgccattttactgatccactttatatgtgttgctgggatgaagaatctccttttggcagcgatgaaggtgctgatgctctaaacgttcttgaaaatagcctccgtaaagagccggatctggactgtgctgatttccctcaaatgttaattgaaactatgtggggtatgaaatacatcgctatggacagtattcttgaagaggatgttcgtgcgcaattactagtcgatgaaatgagcactatccagagcaatatgattacctacgcaactgcattcggtcagattaaagtcatgggtaaaatctcccataaacttaaaaagatgggactcaatgcactagcgcgtcatcagcttaccgcaaaaattcttcaatggggtgacggtcaggactcaccaatacttcaaaaaatgattgatgaccttacggcgtttcctcacgaaaattaaatactgcatttgtcggcagcaacaactgttaaaaaagtgcgctttgtttatgccggatgcggcgtaaacgccttatccggcctacaaaatcgtgctaattcaatatattgcagaaaccttgtaggcctgataagcgtagcgcatcaggcagttttgcgtttgtcatcagtctccgatgctattaatccttaaatccccgccccctggctaaaatgctcttccccaaacaccccggtagaaaggtagcgatcgccacgatcgcagatgatcgccaccaccaccgcgtcagggttagcttttgccacccgcagtgctccggcaaccgcgccgccggagctgacgccacagaatattccttcccgcaccgccagttcgcgcatggtgttttccgcatcgcgctgatgaatatccagcacctcatccaccagagaagcgttgaaaatccccggcagatattccgtaggccagcggcgaatgccgggaatgctgctgccctcttccggttgcaggccgacaatggtcaccggtttggattgttcgcgcataaagcgtgagacgccggtgatagtgccggtcgtccccatgctggagacaaaatgagtgatgcgcccgccggtttgctgccagatttccggcccagtggtggtgtaatgcgcataagggttatcgggattattgaactgatcgagcagctttccttcgccacgattcgccatctccagcgccagatcgcgcgcaccttccatgccctgctctttggtgacaagaatcagttccgcaccataagcacgcatcgccgcacggcgttcctggctcatgttgtcgggcatcagcaatttcatgcgatagcctttcagcgcggcaatcattgccagcgcaatgccggtgttaccactggtggcttcgattaagacatcacccggtttaatttccccgcgcttttccgcctcgacgatcatcgaaagtgccgcacgatctttcaccgaacctgccgggttattgccttccagttttaaccacacttcactgccgttatccggccccattcgctgcaacttcaccagaggcgtattgcctattgtttgttctaatgtactcacgatctctatccatacgtggtgttgcctgatgcgacgcttgcgcgtcttatcaggtctacaggttacaaaccttgccattaaaaagcccggatcgcgggaagcgcctccgggcgtttaacattcactcaacctatcaggcgctttgtgcgagagcaagttcctcatcgcgggtttcgatacgctcgtcgccgttatacagccgcgcatgttgcagaccaacgaataaacgctcgccacgctgcggggcatcgtcgccatgcatcacgaccgtcagcggttcgttgtaccaccccagcggctgcaccactaattgggtgtagtgacctttcgggctggcttccagtacctgtaccggcagcggcgaatcgaggctggtacggcggctgatatccacttcccaagggcgcaggaagagatccaccggcccctgatacgcaggtgtgtagcccagcggccagcgatgcgcgccaacatggaactgcccgccgcgaatggttccctgcaggcggttcacttcgcccataaattcgagcacaaaacgggtcgccggttcgcgccatacctgatccggcgcgtcagcctgttcaatattgccctggctcatcacaactacacgatcagctacttcggtcgcttcttcctgatcgtgggtcacaaaaacgctggtgaattttagttcttcatggagttgacgcagccagcgacgcagctctttacgcacctgcgcatccagcgcgccaaacggttcatcaagcagcagaatttgcggttccacagccagcgcgcgcgccagcgccacgcgctgtttctggccgccggaaagctgcgccggataacgatccgccagatgggcaagctggaccatttccagcaattttgtcactttcgctttgatggctgcggcattcgggcgctcgcgacgcggcagcaccgtcaggccaaaagcgatattgtcgaacaccgtcatatggcggaacagcgcgtaatgctggaacacgaaaccgactttacgatcacgtgcgtgcaggcggctcacgtcggtgccgtggaagcgaatatgcccgctggtttgatgctccagcccggcgataatgcgcagcagcgtggttttcccggaaccggacggccccagcaacgcgaccatctgacctgaaggaatatccagtgagatatcgttcagcacctgggtgcgaccaaacgacttcttaatattggcaatctcaatgctcatgatgttcctcctgctgtgcgcgtttttcctgattctccaggcgccactgcaacatactttttaaaaacagggtgataatcgccatcagcgttaacagcgccgcagcggtaaaggagccgacggtgttgtagtcctgctccagcaattcaatctgtaacggcagcgacagggtttcgccgcgaatcgagccggaaaccaccgacaccgcgccaaactcgccaattgcgcgggcgttggtcaacaccacgccataaagcagcgcccagcggatgttcggtaatgtgacgcgacggaacatctgccagccggacgcgccaagcaaaatcgccgcttcgtcttcctggctgccctggcttaacatcaccggcaccagttcgcgcaccacaaacggacacgtcacgaagatggtgaccagcaccattcccggccaggagaacataatttgcaggttatgctcgtcgagccaaccgccgagcgggccgttagagccgtagaacagcaaatacaccagaccggcaaccaccggcgatacggcaaacggaatgtccagtagcgtcagcagtaactggcgtccagggaagttaaagcgcgtcaccagccaggccagcagaatgccgaacaccaggtttaccggtacggcaatcagcgcgatcatcaccgtcagccagatggcgtgcagcatgtccggatcggccagattctgtaaaaccggcatcagccccttgctgaatgcctgcacgaagatgtaaatcatcggcaccagcaggatgaacgccgaaaccagcatcccgatgccaatcagaaaccatttgccccagttaatcgggcgcgcgtcataacgcttcaattgggtaacttccgccattaatgacctaccacacgccgaccaaagcgactttgcagagtgttaattgagaacagcagcagcagagatgccgcgaggatcaccgaagcaatcgcgctcgctgccgggtaatcaaactcctgtaagcgcacaaaaatcatcagcgacgtcacttccgtcttccacgcgatatttccggcgataaaaatcaccgcgccaaattcaccaagactacgggtaaacgacagcgccacgcccgccaccagcgccggagaaagctccggcagcaccactttgcagaaactctgccagcgcgttgcaccaagcgtttccgccgcttcttcatattccgggcctaactcttccagcaccggctgcacggtacgcaccacaaacggaatgctggtaaaggccatagccaccgcaatccccagccatgtataggtgactttgatatcaaacttcgccagccattcaccgtaaaaaccgtttacggaaaagagcgaggccagcgttaaaccggcgacagccgttggcagcgcaaagggtaaatccatcagcgcatcaagcagcgtgcggcctgggaagcgatagcgggttaggatccacgccatcagcagaccgaaaacgccgttaaaaatcgatgccacaaacgccgacagcagcgttactttgtaggccgcgaccacctgcgggttggtgatcacctcccagtactgcgcccagctcatctgggccagttgcatcaccagcgcggagagcggcagcagcaaaatcaggcacacaaacagcagactggtgccgaggcttaaggtaaagcccggcagcacgcgtctggaggagacagcaaacatcagttacgccccgccgctaacagcttgtctaactcgccgccgctggtgaagtgggttttcatcacttccggccaggagccaaatttgtcttccacgcggaacagctcggtctgcgggaatttgtctttcagtttgtccatcacctccgggttattcacgcggtagtaatagtcggtgatgatggtttgcgcctgcgggctatagagccagttcagataggctttggcggctttttccgtaccgttggcctgcacgtttttatcaacccacgccaccgggaattccgccagaatgttggttttcggaatcaccacttcaaagccctgcgcttcatactgtttacggatgttgttcacttccgattcgaagctaatcagcacatcgcccaggccgcgctcggcaaaagtggtggtcgcgccacgaccgccagtatcgaacacttcaacgtttttcaggaactgggtcataaactgttcggttttgcctttgtcaccaccgtcagctttatccgctgcgccccatgccgccagataggtataacgcgcgttacccgacgttttcgggttcgggaaaatcagcttcacgtcggagcgcaccaggtcgttccaatcgtggatattcttcgggttacccttacgcaccaggaagcccatggtggagtagaacggcgagctattattcggcaggcgcgactgccagtcggccgggatcagcttgcctttatcgtgcaggatttgtacgtcggtcacctggttataagtgacaacgtcggcttttaagccctgtaaaatcgccagcgcctgttttgatgacccggcatgagattgttttatcgtcagtttgtcgccgccgttatcttttgcccattgttgctcaaacggcggattcagggcggcaaacagctcgcgggagacgtcataagaactgttcagcagttccgttgcctgtacatggcccgccagcagcagagaagcgaccagcgcgagtgagttctttttcagtaagttaacggccattgcgcacccttataaatttaatgactttctaatagccatcatatttataacggacgtgaaaggagtaacggttttatataccgtttggtgatttggaagttgaaaagggaataagaacttggttcaacaggcgtaattgttgcagtcagtttggacacgaacagcgcggagaaaccggagcgtacacatagtacgtgaggatttcgagcactgcccggggccaaaatgacaaataaaatagcctggtgaacttagttcaagacgaaatcctccccacaaatgcagggaggaaacagaggtgaatcagataccgacgctaaccgtctccggcagtgtgctgccgccatcaatcacattctgtgtaccggttaaatagctggattcatccgatgcgaggaaggccgccagttcgccgacttccagcggatcggcgaggcgacgcatcgggattgctttcgccatttcagtcagcaccgactctggatcttccgggttcgactggcgggcaatgctttccgccattggtgtgcgcacgtatcccgggcaaatggcgttaacgcgaataccagactgcgcgtactccaccgccagcgattttgtcaggccaacaatcgccgctttcgttaaggcgtacgccgtttcgccaggatcggccaccatatcaccagtgactgaagacatcatcacaatgcgaccatctttgcgggcaatcatctccggcagcaccgccttcgtgacgttccatacgcctttaatattgatgtcaatatggaaatcgcgatcgtcatcgctcatatcgaggaaactgcccagacgacaaacgcctgcgttattcaccaggatatcaatgcgcccttctttttccttcgcgcgtttgatagctgcggctaccgacgccgggtcacgcacatcggcgacaaccgccgtacagcgatgaccacgaccacacagttcgtccgccagcttttcgatctcaggggagatatccagcaagattaggttcgcgccatgacgtgcaaaagttctggcaattccttcgccaattccctgcaatgcgcccgtaatcagtgctgtcttgcccgtgagtttacccattttaatgctctccttgttaatacagagcgttacactccattccctctgaaaatacaggataaacaaaatattgctgcggatcagctcactaattcaggaaaatctcaatccagtcgctgctttatgcatcatttcaggcgttgtgttagctcactgctgcgctgaatcattttcaatgactccacatcattgagttgcacaaggccaacaaacagtaaatcggtaacagaattttgcgccgtgcgggtagacatcgacgagctacgccattcggtttctccggaaacggtatcgagggtgaaatgcgccagccgccgcagcggagagtcagtcagagaagtaatggcaatcaccgttgccccctgctttcgtgccgcttctgcgcacaagacaatctcttttttactgccgctgtaagagatagcgatttgtacatcgccttttttcaacgcctgagaaacggtggcttgtacgtgcgtgtcggcttcgcaggccacgcgatagccaattttcatcagtttgaacgacagatcgcgccccaccagcgccgatccgcccaggcccgttatctggataaacggtgctttactgatgacctcaatgattttttgcagccgcgcgtaatcgagcaacgcgcaggtttgctccagcgccagctctttttcgcgattcagtttgcgcgcgatcacttccagcgaatcatcactggtaatcgaactgtgcaggtgcagtgccgtggcattcgttttctcccggctggcactgtattcgcctattaacgccatacgcaattcagtaaatccttgcgcgccgagtttttgggcaaatttcactatgctcgactggctaatgccgagctgtttcgccatctgccgtgaagaaacggattgcagctcactcacgttggcctgcagaaagtcagcgattttttgctcgttttcggtgaattcactccccgcattgcttattttcgtcaggtacaacatcttccactctcctgggctggcagcataaattccgcttaagttcttatgacgctcttcacactctgcgagtgtagactcaatgattcctttaagcctgtcaattcgggatatatgattccatacatctgcaattatttgatcgtaaatagtaaggtcaccaccgatgcaatttgaaaagatgattactgaaggctcgaacaccgcctcggctgaaattgaccgcgtatcgacgctggaaatgtgccggattatcaacgatgaagataaaaccgtaccgcttgccgttgagcgcgtactgccggatatcgccgcggcgatcgatgttatccacgcccaggtaagcggcggcgggcgtctgatttacctcggtgcgggaacatccggtcgtctggggattctggatgccagcgaatgtccgcccacctacggcgtgaaaccgggtctggtggttggtttgattgctggcggcgaatatgccattcagcacgcggtggaaggcgcggaagatagccgggaaggcggtgttaatgatctgaaaaatattaatttaacggcacaggatgtggtggttggcattgctgccagcggtcgcacgccgtatgtgattgccggactggaatacgcacgccagctcggctgccgcacagtgggaatttcctgtaatccggggagcgccgtttcaaccaccgctgagtttgccattacaccgattgtaggtgccgaagttgttaccggttcttcgcggatgaaagcaggtacagcgcagaaactggtgctcaatatgctttccaccgggctgatgattaaatccggcaaagtgttcggcaacctgatggtcgatgtggtcgccaccaacgaaaaactgcatgtgcgacaggtcaatattgttaaaaacgccaccggatgtagcgcagagcaagcggaagcggcgttaattgcttgcgagcgcaactgtaaaacggccattgtgatggtgctgaaaaatctcgatgccgcagaagctaaaaaacgcctggatcaacacggcggctttattcgtcaggttttagacaaggaataacccatggccaaagagatcagcagtgaacttctgaacaccattcttacccgtgtcggcggaccgggaaatatcgccagttgtggtaactgtatgacgcgcctgcgtctgggtgtacatgacagttcactggttgatcccaatatcaaaacgctggaaggcgtgaagggcgtcattttgaccagcgaccaggtgcaggtcgtttttgggcctggtaaagcgcatcgtgccgcaaaagcgatgagcgagctgctgggagaagcaccggtacaggatgccgcagaaatcgccgcccagaacaaacgtcagttaaaagccaaacaaacctccggcgtgcaacaatttctcgccaaattcgccaccatcttcacgccgctgatccccggttttattgccgccggtctgctgctggggatagcgacgttaattgccacggtgatgcacgttccggcagatgctcagggaacactacccgatgcgctgaattttatgaaggtgttcagcaaaggtttgttcactttcctggtgattctggtgggctataacgccgcccaggcatttggcggcacgggcgtaaatggcgcaattatcgccgcgctctttttgctcggttataaccccgcagcgaccaccggttactacgccggttttcacgatttctttggtctgcccatcgatccgcgcggcaatattatcggcgtgctgattgccgcgtgggcctgcgcccgcattgaaggcatggtgcgccgctttatgccggacgatctcgacatgctgctgacctcgttaatcaccctgctgatcaccgctacgcttgcgtacctgatcattatgccgctgggtggctggttattcgaaggtatgtcatggctgtttatgcacctgaacagtaatccgttcggttgtgcggttttagccgggctgttcctgatcgccgtggtatttggcgtgcatcagggctttattcctgtttacctcgcgttaatggacagccagggattcaacagcttatttcccatcctttcaatggcaggcgcgggccaggtgggcgcggcgctggcactctactggcgggcgcaaccgcacagtgcgctacgcagtcaggtacgcggggcgattattcccggcctgctgggcgttggtgaaccgctgatttacggtgtcaccctgccccgcatgaagccgtttgttaccgcctgtttaggcggcgcggcgggcggtttgtttatcggcctgatagcctggtggggtctgccgatgggcttaaacagcgcctttgggccgtctggtctggtagcgctgccgctgatgacttccgcacaaggcatccttccggccatggcggtttatgctggcgggattctggtggcatgggtttgcgggtttattttcaccacgctctttggctgccgtaacgtcaatctggactgatatcatgaaacggacaatgctctatctttctctgctggctgttagttgtagcgtcagcgccgcaaaataccctgttctgacagaaagctcgccagagaaagcagggtttaacgtcgaacggcttaaccagatggatcgctggattagccagcaagttgatgtcggttatcccagcgtaaacctgctgatcattaaagataatcagattgtgtatcgcaaagcctggggagcggcgaaaaagtacgatggcagcgtgttgatggaacagcctgtcaaagccaccaccgggacgctgtatgacctggcctcaaacaccaaaatgtacgccacgaacttcgccctgcaaaagctgatgagcgaaggcaaactgcatcctgacgatcggattgcgaaatatattccggggtttgccgatagtccaaatgacaccattaaaggcaaaaacaccctgcggatttctgacctgctgcatcacagcggcggtttcccggcagatccgcaatacccgaataaagcggtcgcgggcgcgttatattcccaggataaaggccagacgctggagatgatcaagcgcacgccgctggaatatcagcccggcagcaaacatatctacagcgatgtcgattatatgctgcttggatttatcgtcgagtcggttaccggtcagccgcttgaccgctatgttgaagagtcgatttatcgcccgctcggcctgacacatacggtatttaacccgctgctgaaaggctttaaaccgcaacaaattgccgccacggaattgaacggcaatacccgcgatggcgtgatccatttcccgaatatccgcacctccactctctggggtcaggtgcacgatgaaaaagccttttattcgatgggcggcgtttccgggcacgcaggtttgttttccaataccggcgatattgcggtgttaatgcaaacgatgctgaacggcgggggctatggtgatgtgcagctgttcaatgcggaaacggtgaagatgttcaccaccagctctaaggaagatgccacttttggcctcggctggcgcgtgaatggtaatgccaccatgacgccgacgtttggcacgctggcaagcccgcaaacctacggtcacactggctggaccggaacggtgaccgttatcgatccggtgaatcatatgacgattgtgatgttaagcaacaagccacattcgccggttgccgatccgcaaaagaatcccaatatgttcgaaagcggtcagttgccgattgcaacttatggttgggtagttgatcaggtgtatgcggcgttaaagcagaagtaataaaaaggccagtcagtaatgttactggctggtctgagagtgctgacaaacgcaaaactgcctgatgcgctacgcttatcaggcctacgtggagcccacaatatattgaattagcacgatttcgtaggccggataaggcgttcacgccgcatccggcgtgtacaacgcgcacttggtcaacaatctgaggccagtcagtaatgttactgcctggcctttaatcaatgaatcagaaacgcttacagcgccatcaacttgtccagcgacggtgcgaaataatagccgccggttaccggtttggtgaaacgcaacatcgcatcacgcttaccatcggtatcgccaaacatgctcagcagttgctgctcaatgttatgcagacgcgcgcagtaggcgcagaagtacagaccgtgagtgccactggcagtgccgtacggcaggctctggcgaacaatcttcagccctttgccatcttctttcagatcaacgcgggtgaggtgagaggtttccggacgttcgtcgccgtcgatctcttcgttggcctctttggtgcgcccgatcaccatctcctgatcgtgaacgctcatccggttgagctgcttcaggttgtgttcccaacgctggacaaacacatagctgccgcccgcatccacgccgtctttgataaccgccacttcgcgacgcgtctcttcacccgccgggttttccgtaccgtcaacaaagccgctcaggtcacgctcttcaacccaacggaagccgtggatctcttctttcacttcaatgcagtcaccaaaggcttccatcgccgcctgggcgacagagaagtttacgtcgtgacgcagagaaagaatgtggatcaacacatcgaactgggtcgtcggcgcaaggcctttaccgtagcccggaaaatctttcagctcttctgccccaacgccgccgctcagagcgcgccaggtgttgttaccaaaggcaaccaccgcaccaagatgcgcgtccgggaatttcgcttcaaaagttgccagtttgtcggcaaatgttttactggccgcacgcagggcgtcaacttcccctttcacgttggcttcgatccaaatcgccgcgcggcaatgttctggcaaaatgccactctgaacctgagacattgttcctcctgaaaataataatgccacgcaatccgtggcattgttgagcgctattttacgtgttttttcgcggcggcggtttgttcagacgcaaattaacgccgccagataattttactgactttccagtttttcagggtatcgtccgaaggcattaacccttcaggaccacgccattccccgctgaactggtagctaatatgttgactgccttcggctttacattcgacggcacgattatcatcaccatcagctttttggcaattgccaaatgctttgctgtaaaggtcgctaaacggtgtaccgattttaacaccggtgtcagcaggaatatcgctatccagcacgtcaatgcgactgatcgtgccttgatcgccgttaatcaccatcgccacgttgtcgcccttcatcacttcaaaaaagcgcaccacgttgccgttcgcggttttcattccgctgcgcaggcgataatcgccatcaagcgcatcggcaatggcttgttcttgcagtggtgtggacgccgttaattcacccacgccctgctcgctcactttggtggacgacccaaaccagttccacgggttagcggcagaccagttaactgacgacatcgtggaacagccggtcagcatcaatggcatagcgcataacattaaacgcagcgatttcatgtcacttcctttggttattcaataacgttgcttggagtgcaaattcaccaaaaagtgccgttattcttttacttcataaaaacaagcgcgtaaacgtcgattggtcagcagccagattaacgccacaatatccgccactaccagcgccagaccgataccgctaacggattcaccgttcagccacagccacggttgccagcaaagtaaaaccacctgcgccaacagcaacagaaaatagagtacacgccaggtgcgaggaaacgtagcccgccgaccgctcaacaaaaacgccagcaccgccggaatgccaggaatcagccccagccagaaattatcgtgatcgggataaaacagatttagcagcgcagtaccctgctcgcgcgacgcaccggcaatgacaaacagcacccaggttcgcgcctgaagcaatagcacaagccagaagagcaagggtaaacgcaggcgaccgtgcgcatcataatggacaggatgaaactcagtactcttcatcttcaatcaaacgcttacccagactcagcacgtcggcgtgttcatatcccaggcgttcatacattccgagcaccatgtcgttatcttccggcacattgatctgaattttcgggcagccacgagcaatcagctttttctccagccgattaagcaacgcattggcaatcccacgcccacgaaactctggatgcacgccaagataataagcagacccgcgatgcccgtcataaccgcccatcaccgttccgaccacgtcaccgtttacctcagcgaccaaaaacaaactgacgtcatggttcatcttacgctcgatgtccatttccggatcgttccacggacgcagcaagtcgcaacgctcccaaagggtgatgacctcttcgaaatcttcctggcgaaatacgcgtatctccatggtattcgttacctttttgcgggttaaaaggctgattatggcgtgaacggtcgaattagccaatatctgacgaaaatcggttgaaaaagtggcataatggggagttgtcaactattgaaatgaaaagtaaaacaattctcaacagcaaaccgtcgtaacggattacgcgatacgatataacatctggaactttattattacaactcaggccgtatgagcacttttaaaccactaaaaacactcacttcgcgccgccaggtgctgaaagccggtttggctgccctgacgttgtcaggaatgtcgcaagccatcgccaaagacgaacttttaaaaaccagcaacggacacagcaagccgaaagccaaaaaatctggcggcaaacgtgtcgttgttctcgatccaggtcacggcggaattgataccggagcgatcggacgcaacggttcgaaagaaaaacatgtggtgctggcgattgctaaaaacgtccgttccattttgcgtaatcatgggattgatgcgcgtttaacgcgttctggcgatacgtttatcccactttacgatcgcgttgaaatcgcccataaacatggcgcagatctgtttatgtcaattcatgccgatggctttaccaacccgaaagctgccggtgcttcggtatttgccctctctaaccgtggggcaagtagcgcaatggcgaaatacctgtctgaacgcgaaaaccgcgccgatgaagttgccggtaaaaaggcgactgacaaggatcacctattgcaacaagtgctgtttgatctggtgcaaacagataccattaaaaatagtctgacgctcggctcgcatattctgaagaagattaagccggtgcataaactgcacagccgcaacaccgaacaagcggcatttgtggtgttgaaatcaccgtcggttccttcggtgctggtggaaacctcgtttatcaccaacccggaagaagaacggctgttaggcacggcggcgtttcgtcagaaaatcgccacagcgattgctgaaggcgtgatcagttatttccactggttcgacaaccagaaagcacattcgaaaaagcgataagttatgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaactccctcacccccactcccgcatccgctgatgcagcgtcagtgacggcttctcggaaaacagctgctggtaatccgtggcaaattgccccagatgccagaatccccactgcatggcggcgtcttttaccgtcatactttgcgaccacggacttatcagttcgcggcgtacggcgttcaggcgaatgcgtttcagccacgcgttcgggccaatgcctaaaatagcgtgaaacgcgttttgtagcgtgcggcggctgacatgcagttgattacacaaatccagcaccgtcaccggttcggacatgttttccagcacatattcacgggcgcgggaaagcaatcgacggtaactctgatgactgatgctttccgccgtcaccattggttgcgcttcttccagcatggcccccatcgccattagcaaattatcccccagcacttttcgcactgcaggctgatggagattttccggattctcgcaaaacgtcgccagcgcctgttggacaaagccccacagcgcggctttatgctgctctttcacttccagcgccgactggttacgcaacatatgtaatacccgatccgggttatgcaaaaagttagcctgccgggtgatgacatcttcagaaagcaccacgcccaggatcgtgtaatcatccggcgtgctcagttcaaattcagtgccaccagggcgggtggcgatttccgcgcttcccagacattgcgaaccgataaatccctgctcaccgcgcgtcgccggaatgccaaaccagaacgagttcggccagaccaggcacgactgacgcagcgccagaccggtgtattcacgaaaaacctgaatatcatcgagtagaatttccgtaaattcaccatgaaacttgcccggatgcagctgatcgtaaatctgctgccaggcggtaatcgttaaagcatgttcatagacatccgttgtctgtcgttgatgaacattatccacttcgaccttcggcgtgagcttcaggttttcgggtaagggttcatgataaagatggtgcaaattggctgtacgggtctttttcatgatgttaatgccgggtgttgtaggacacccggcacctccgacaggttaatggggcttgagacgataacgactactgcgtttacgtaacgtcccggcagaaaagagctgttcgagcgcatttctggctttttccagcggccagccaaagtgggcagccacttctcctgccgtcattccctgacgtactgatgttaacagcgccaacaactcgtcagcagattccgcgacgataactggcgcgtcgggttcccttacgggttgcttcggctggcggttaaagccagtaaccagccactgggtgtcatcgtctggccgaccgatctccttgcggctgatgacacgcccggtacgcatcgcggcagcacaacctgcgtccagcgccgcacgacacgccgccagatcgccttccaccaccagcgttaagcgaccagggtcaagcacttcgtgactgagcagacgaacgttagctgctttgagcatggcatccgctgcatctatcgcggcgaccatgccgtccacttccagcaatcccagtgcattgatcatcggcaacctccgttacgcacgctggattggattacgcgcgatttccagcactgcatcggtaaaggcgttacaggctgctttacacgctgcctggctaccggttaaaaatgctgccgagtagttggtttcagacggtggcgggacataggtcgccagctgtacgtcggcagacttcagggctgcatcaatgccataggtcgcttccagcggcggtgccaccagatacgccatcggatcgccaagcgtgatcccggcggttgatgagagataagaaccggtacgcgaaactacatgtgccaggaatgccgtatcttgcgcgtcattagcccactggaaagctgcgccattttcaatatgcgcaatcatcgcatccagacctgcacgcacttccgccgggtttggcccaccaagcataatcagcacttcaccggcagtcggtgacgggccgtgtgcagcgcccgcatatagcgagcggccatacaccacttccaccatcgcctgcttggtcgcttcatcagcggcaatgtaggtgacgtcatcggagtcggcagaaatcagaccgaggctacgaatatgcggcggcaatttcagttcacgcgcaaaatcggcgttaacggaggcaatcacccgcatagcggtgacagacggtcgaatcaaatctaaagctggcatgatgcctccttatcgggtcatgttgatgccggatgctttctgctccagcatacgtttcgccaaatccacaatgacggctgcggcttcaaccggcggcgtgccgccctggtgaatgttagagatacaggtgcgatcggcctcaacggtggtcgccatacgcggcgagtaaacggcgtagcaggagaggctttctgactgacccaaccccggacgttcgcccaccagcaggatcactactttcgcgccgaggatctcaccgatctgatcttcaatcttcacgcgaccataacgaacaaagaatggtgtaccgactttcagcccggcctgtttcaggcccgccatcagcggtggcaggatctcttcgtagttcacggtgatcgcatcagttgacaggccatcagaaataacgacctgtacgtccggattggcaacacactgcgctttcagcgcttcaacagcttctgcacacaggcggcggcccatatccgggcgagtcaggtagagatttttgtcgctaatttcagagcgtacttccagcaagccctgcgctttcacccactcttccggcacttctttcagtacggtatctttcgaacgagagtgatcggccaggaaacgcagcagcgcctgcgtacgtggacgcggaccggcacgaccggtacaaacgcgggccacggtgctgcggcgcagttctgttaatacgtctgcgcgatgcggattttcaacaccaatccacgcttttgcttcagcggaacctaaatccagcgcacagctttccgaggtcaccggtgccgcacagttggtggtggcgcactttgcttctgacggcgcgggggccgcttgtcccattgacgccatcacgctgcgtacaatttcttcaatctgtttttgatccatgatatgttatctccgcgtcatcagaagaacagtgacggatcgcccgcccgtttggtcaggcgaccgtttgccataatgcccatgctttccagccagcgttcaaactccggtgacgggcgcaggttgagtaactgacgcacagtggcggtatcgtggaatgcggtggtctggtagttgagcatgatgtcatcacccagcggcatccccatgatgtagttgcagcctgcggtggcgagcaggatcatcaggttttcgttgaggttctggtcagcgtcagcgtggttggtataacagcagtcacagcccatagagatgccgctcagcttgcccataaagtgatcttctaagccagcacggataatctggcggtcgttgtagagatactccggcccaataaagccgaccacggtgttgacgataaacggatcgtaatgacgcgccagcccgtagttacgtgcttccatcgttacctggtctgcgccgaagttagcgccagcggatagcgcagagccttgtccggtttcgaagtagaggcagttttccccggcgatacggttgaactccgcgcccactgcgcgcgcttcgtcgagcatcgccagctccacgccaaactctttcagccctttttcgctgccacagatactctggaaaatcagcccgcccggtgcgccacgacggatcgcttcgatctgggtggtgacgtgcgccagtacacagccctgagttgggatgttgaatttgtcgatcacgccatagatggtatccaacacgcggcttaagttttccacgtcgtcagtcaccgggttaacgccgatcaccgcatcgcccaccccgaaggaaagcccttcgtagatttgcgcggcgatactttgcacgtcgtcacgggtgtcatttggctgcaaacgggcgctaaaggtgcccggaataccgatggtggtattggcctttttgattaccggcattttcttcgcgccgtagatcaggtccgcgttggagcaaatcttcgctaccgccgcgaccacttccgaggtcagccctttgcgggtaaaggcaatgtcgtccacgctggtttcatcgctcagcacatactcacgcagttcgctgatgctccagtttttaatctggttgtaggccgtttcgttaacatcgtcctgaatcagccgcgtcacgcagtcatcttcataggcaatcaccggattattgcggatgtccgctacggtcatttccgacaacacctgctttgccgccacgcgctcctgtgagcttgccgctgcgacgcccgccagcacatcccccgaacgcagttcgttggctttagccagcacctcttttacatccttaaactgatatacattgccgaacaatgtggtctttagtttcataagtcgttccctcaggaagaatcgatgattggcatttttcacagcattctaacaatcacgtttcatcgtcagcccttgtcgtgtaaggtggttgcctaaacacgcccgttattcatcacgccgaacgcgccggatacatgatcggggttatccagtcgttaaatcaaggtatccggttttgagcaagacaccactcacagcaaaggccatagacgccgcacagccgcaggacaagccctataaactcaccgattcactgacgccggggctgtttttgctggtgcatcccaacggttcgaaatactggcgattcaggtattggctgaataaacgagagtttttgcaggccattggagtttacccgctaatcacactcaaagaagcacgcaggcgcgccacggagagcagatcccttattgccaatggaattaacccagtggaacaagcccgcaaggaaaaagccattgatgcgctcaacatggcggcaggatttaagaaggtggcggaagactggtttgctaccagggttggagggtggtcggaatcctatgcaaaacaggtcagatcggcactagaaaaagacgtctatccggtacttggcaagcggtcgattgtcgatataaccgcccgtgacgtgctggcattactccagaagaaagaacgtaccgcaccggagcaggcccgcaagctacgccggcgcatcggtgagatcttcaagtttgccgttatcaccgaactggtaacgaggaatccggttgcagatcttgatacggcactgaaggcccgccgacctggtcacaacgcgtggataccgattagtgaaattccggccttctacaaagcccttgagagggccgggagcgtccagattcagacggcaatacgtttgcttatattaacggcattaaggaccgcagaactgcgtttgtgccgttgggaatggataaacctggaggacgcaacaatcacattgcccgctgaagtcatgaaggcccgccgcccgcatgtggtcccgctatcacggcaggcggtcgagctattgcaggaccagttcacacgcagcggatacagtgctttcgtctttccaggccgattcatggataaacccttgtcagccagcgcgatacttaaagcgcttgagcgtatcgggtacaagtcgatagccacaggccacggctggcgcacaacgttcagcaccgcacttaacgaatcaggcagatactcgccggattggattgagatccaactagcccacgtcccgaagggaataaggggcgtttataaccaggctgcctacctgaagcaacggcgagcaatgatgcaggattacgccgacgctattgattcaatattggcaggtaacggcaatcctctagaaccggaatgaataattaagcggcttttttgcaaagcgcaattttgcattttgtataagtatttgttttgtgtggtttaactatcacctgataagaaacctgtattcaatttgccggattcgtccggcttttctttttcgctaattattccattattccaattaagtggaataaattattcaatatcaagaacttaaatccatgtttgcaacgaaagatccagagttcgaaaataggatcaacacaaataaaagcccccggaatgctgcaacatgccgggggcggtatgagaaacaagctaaaggagaatttctcatgtctgatatgctagcagtagaacaagaaacaaacaatgatgttcgtcaatttttaaacaaaattaacgagttacggaataaagcacccaaaaacgaagagactaaacacgaagaacacacgccagataatcacgaggaaacagatcatcacgaggcaaaacagcaggagcaagcctggcgtggcaacctgcgctacctggacacattaaaccgacttgatgaagtattgccccgcaaactgtacgaaagatgggagaaagaacatacagtcaacgacgaggctgtgctacgtgctctttgttacttcgctggtactggcaaaaactcacagttgggatggtgcagggttggtaggggaacaatcgacaaacgagccaggctatcaaaaaacacggttaaaaaatgcctcgatcgtctggtcaaccacttcaaacttgttgagcgtactgaaggctatataccaggatcggcagaaagggagtgcaacgaataccagttattattcaagccgtacaacatgaaataacggaatcaggcgggcaatgttcccgccttttctttgccttaattccatgaattcaggtgggtcaaaagttgccgttagtggtgggtcaaaagttgccgttaaggtgggtcaaaagttgccgttaaggtgggtcaaaagttgccgagtaagaattctactattaagaattctaggcgacgggagttttttagcctcccggtcggtcatagagagtcgcctagagttaaacagaagaattatttcgccgcctgataggtcggctggttgcgagcattaaccatgctgattagcgcaatcatttccagcaagctggaaacgcccattcactcacgcacaacctgaacagcagaccaacaaaccatcatggcattcgttcatggggagcgcggtatatctcaaagggtgatttcttattggtgggccttcggaaggcttcgagcaattgccagcttaaaagacgggcttagcagtgatggttatccgccacgaatgtccgtcatattgcattgcgcagaaacgcgtggcactgagggagttttccgaattagttttggggaccctttccctgcttctggagcaaaagacgaacggcaaatgcagtgcttccttgtacgactgcagcgaagaagaaaagctgtttgttaagcgcctgaagttaatcaaagcggatatccacgcccagctgaaggcctgtgattgcgatatttctgaatgacaggtggaatcatgaaacacgtttttaaatatcttgattttgcagaagaccgcgaacacgcagaatcagtggcgaccaaagagttaaaactggaccacgtagaaaaattcgctatccgcgatctagccaatgatatcaaagagcgtgggtgtgttgagcttgtccagcctggtggattcgatgagctggttcagatctatgaggccggaggcgatggaatagagccactcaattgtggaatcgaatcaaggaaggtggcaattgctgccctgcttcgcgtcatgcgtgaaccagactttcaatgcctggaaatggttcacgaaatcataagaattgctagagatttggaagcgccagttgacgctccgttagattgctaacgccaaaattagcgctgaattaatgggtaattattgcggtttttgtcaattttcaacctcaattcttgcgaaaaatggcaaaaataacggtatttttcatcatttattgggggttttatggaaggcgaactgatagaaaacaatgggttagacatttatgacaccagcgaaacaccgaaaaagcgcggtcggccagctaaatataatgaaaaaatagcaacgcaaatcgtcctattggtaagcgaaggttatagtttgcgcaagatcagcatgatgccagggatgccgagccaccgtcagatgatgcgctggcaactggagcatatggacttcagggaagggatagcctggatgtcgtggctatggtgcgctgaagctggccgacgtgccgtcgagataatcgacgaggttgatataaacgcagaggatgggccgaagcagttgcgcaaagcagaagcaaaggcaaaggcactactggcagcagccaagctgaatagtttgaaacattcaccatttggagatgacaaacaatgagcctgatccgcactgaaaccagagacacaaaacgcgcagctgacccactgcacgacctgcgtagcaagccgttttctgagtggggcgaagatgaaatcaggcgttttaatctgatagacgcgcttcttgagtttgtctacacagacacatccagcccgttcggtatcggcatgaccttcgattacacggagtgctgggaaattggtgttcgtgacgactgcctggtaatgacacgcgttaagccggtgcatccagaatatgcgaagcactggaacatgaaaggcgtcatgaatgacaaaacccgcttccacgccgacaagtgggtagggtacagcaaggtgcttgcctgggtgagcttatcgcacaaagacaccttcacgggtgcgaaacggtttcaatacttccaaacgatgtacgacatggaacggcaaatcaacgcaaacctgccggttggcggccttcccaacgttgacacagagcgaactggcaaactgttccaacgcgatgacttttctgaggatagccatgccaacgatccgaagttggttggtgatgattacgtcccccaggcaccggagcaaatcaactgaattttcggacaaacgcgcgcgtagccgacgtcagcggcaagactggcggtcatttccccgctcctacgcgaaaaatccctcacaactaccctgcaaattttccagatttcacgtacacgcgccaaaaataaaggcccaggcagttagcaacctacccgggcctttctcacaatccccgctgacattatatcacccatctttccgttttcaggtgggagactgatggccgccgacgttgcacaattgattaatttctgaacattcaaatcaactcccaccaaagccaacaagatgggaggtgaattttgtgatgcagatcgctttttcccttcaggcatttttgtttaattcaatcaacgaaaggcagttcccaacaacaaaataaagatgggaggtaaaaatgaaacggtgggaagtggctttactggtgatggtaatgttggtttgctgtattgaactgtgaaggaggacgccatgaaacttttaatcgcaatcatcctgatggtgctgactggtgtttgctttgcagatgttggtgattacaggctgaacggggaggataacgcaagaattgaatcagtcgttactgataactgtgaaaaaacagccgtattggtaggcggtgacaggcttgcgagggttgagatcgaatatatagcgacattgtgcaagccggtggctttggtgattatttacgacagatttgacgatatagcggcaatccctcttaaggtgacgttgaaaaaggtattgaaagagaatagcgatgaaaagattaacctattgaacaagatgggggatctggctggtcgtatcgttgcagagcagtatttaggcatgagttttgagtaaggaggcaatcatgaaagtgttaggtaatattttatggtgggcttttgttggtttcatggcttacgccactttgattaagccggacaacactgatccagctgttgtgaactatgaagagcctttgcctatggagcttgccaactatggcgaaccaggtgaaggggcgaaaatcatgaatgccgcaaaaataatgggtcgcgactacgcatggaaacatgtaaaagaagacaggttgccatgtctgtttgccgccggggttgttgctgataacatcctggtaaaataccatttcagcaatgaaactgagttcaaacttaaagcggcagcggtcagagaatgcgccaacgtagcagaaaacaacggctttgttttggtaggtagagtatttgaaaaacgtaattgattgcgaatagcaacaactaaacaaccaatacacccggcccctcgccgggttttttgtgatctgcgtcaatattcccttccgttacgcttaccctccaccaatacgcgtgttaacctcccaatggattctatgagatgggagataaaaatcatgagttacgaaatcaaaatttgcgacatcctcaaaggcgctgcgatggaaggacaatataagggcgctcaacgtggggccaaatgcgaggagatcgcaaacgagttaactcgccggggagttaaaaacaacaagggagaggttattactaagggcggcgttagccattggctggaaggtagacgggagccaaatttcgacactctggctgaactgtgcgacatgttcggcgtttatgccctgatgccgatgcgtggcggtaaatggattcgagttcacccggaagaccgtggagaaatggaattacgcgaggctgtagctgaacgagatgctattatcgacgacctgaaggcccgtatcgctgagcttgaggcggcactagcaaataaacaagtcccagcagaagcggaagagatgggaggtgaaaaagtggaagaagtggcagcagagcaagcgcccaacgatgaaaaagagatgggagctaaggagtgggttaacccgaacccgaaaaaatacagcgtcggcatgttgtgtcaggtactggctgcaatgggcggcgaatacctgggcaacaacgcagggttacagcagaagatcactgtgttggataacgacggcaaccggaagccaatcagtaacggcgcgttttatcgactgattgagcaggccaaagggagaggattgattagcgttgaacaggaaatcaaacacaagaaagacgaaaacggcaaccagatcggcaaaggcaagaaaggtgacaagctgataactttgcttcccaactggattgataagctgggagacgaataaaccagccttcaaccccatctcatcaatcaacgcccggccccgctgccgggtttttgctatgcaccacaattaccccaaccggatacacagccggatacaattccaccagcacccagccacccagcgccaccgctggcgaataccgcattcaggaaggaaatgcgagtgatttcaccgtcaccggcacaaccgatccgccaaaaagaggcgtaccaatgtcgatatagtcccccgcgcggacaatcacttcgtcaatgactgccaacgggagttgttgtagctgtgggcgcaacaacatgcccagagctttaccaaagtcctgcccggccaccaccagcaggggatgcggattcggaaaacgcgcgacgaaatcgaccaacgcgttgatgaccgtcagtaccgcggcgtaacgcacaggcagcgaggcgggaagcgccagcacgtacgcgtcagttttgggatcaagatccagctgaatcagcgcctgttgccaggcccccaccagatccgtttcatcaatcgggatcgccaccggcaaattgcgcagcggcagttgtacgccctcaagccagattgtgctgccagagagcgaaagggtatgcgcgcccgcgccaatcaccgtggcgcgcacggtttgcgccggaaactgtacgttcatctcacgcaggcgcggatggtcatgcagcgcagttgccagcagcgggccaatatcggcaaaacagaacgggtcggcgggctggtggcgataacattcgcccacgccgccagaaagcgtaatgatttcgggcgtaacacctgcgggcagcaaaccggtttgcatcaatgcctgcgcgagcggtgagagcgttccgtcaatcacttcgacaatcagttctgccatccgccgggtcacctgcaccagctgcgcgccggtcagcgaacgggcgtcggtgcctgcaccgaagcactcatccacaatcatctgccccggtttatgagcgtaaaccacgcgcccgtggctgtcggtttccagcaggcgaccaccgacgttgaggcaggcagtgccgctgatttttccggcatcgaacagggcgtagttcgcggtgccaccgccgatgtcgatattcagtacccgacacagccgttgttcagaaagggtttgtgccccggctccgtgaccggcgatcacggattcgaggtgcggcccggcgctggcaacgacaaaatcgcccagcgactgagagagcgccatcaccgccgggcgagcattgcgggttttcgcgctttcaccggtgatgatgatggcaccagaatcaacgctttccggctcaatacccgcagcatgatattgctcgagtattaaggttttcagttccgcttcttttaaaccgccctgtttatcgacaggggtaaagaacaccggactttgccagctaatttcgcgtttaatgaattcgtagcgcggcacctgcgacaccgccgcacggttaaccagctccagccgggagaaaatcacctgggtggtggtggtgccgatatcgataccgacgctcaatagctggcgagtgttcacgattgtgcctccgcttcggttttagtcgcggtcgcgtcttcttttggcaccagcatcatcgccacgccaatcgccgttacgccgccgatcaacttgccgacaatcatcgggaagatcatggcgttcatgttggcagcggcgaagcctaagtggtcgcccagggcgaaagcagcggaaacggcgaaggcgcagttgatgactttgccgcgggtatccatctgcttcatcatgccgaacatcgggatgttgttggcaagcgttgccaccatgccggctgccgcgatgttgttcatattcagtactttaccgacgctcatcagcggtttttcaaaccagcgagtcagcagcagcaccatcggatacgcccctaacagaacgcaggagatagaaccgataacttcaatggcgcgcatcacctcaccgggtttatcgccaggggccataaagataggatccagaccggggatcagttcccagccaagcaggaatttcactaccgcagcggcaagaccgagggtgatcaatgcaacgaggaatttggcgaagatctggaagccgttgatcattttttccgggatgaatttcagccccagcgccaccagaatcgcaacaatgatcaccgggatcatgttcatcaggatcagggcgaaagtgaattccaccggctggccgttgatctgcacaccggagtacatagcaaccagaccaccagcgatacaaccaatcggaatggtcacaatgcccgccagcacgccgagcgccagataacgacggtcagaaggttcgataatgccgagcgccaccggaatggaaaacacaatcgttggccccatcatcgacccgagaattaacccagagtatagccacgcggctacgtcgccgcccgccagctctttggcgaggaagaagccgcccatatcgcacgccagcagtgttccggcgaacatcgatgggttagcgccgagcatttcgtaaaccggaataattaccggcccgagaacgtgagccagtaccggtgccagcgcggtcataccgaccatcgccaggcccagtgcgcccattgccataaagccttcttcgaactgaccgcctgatccttcgatacttttaccgaacttaccgaggaaacgagcagaaccgccgaactgcgacaggatcctgtctacggcagctatcagcataaagaacatcatgatgtacatgatgatttcgttaattcccatcgcctttactccctgttagttgttatttattggcggatgcggcgtaaacgccttatccgccctacatgtgcaatcccgtaggctggataagacgcggcaagcgtcgcatccggcaattgcaccgcgccactggcggatgcggcgtgaacgccttatccgccctacatgtgcaatcccgtaggctggataagatgcggcaagcgtcgcatccggcatttattgcgccgctgcgtacaggccgacaatctgctccaggctggcggtacgcgggttactgcgcagacaaatatcttccagcgcggcctgcgcccatgcgccgtaatgcgcagatgtcgcaccaacatcgcccagtcgtttaccaatcccaacttccgcaatcagctcacttaccgcgttaatagcgtcacgatcgtcggattttttagttcgcagtgcccgaccaatctgactaaagcgttcacgacaaaccatccggttaaattccatcaccgttggcagcaacatggcgttcgcgagaccgtgcggaatatgcagcgccgcgcccggctgatgcgccatcgcgtggcacaacccaagacccgcactggaaaacgccattcccgccatacatgaagccagcaacatgctctcgcgcgcggcaaggtcgtgaccgtagcccaccgctttcggcagcgatttgccaatcatcgcaatggcaccaatcgccagactgtcggtaaacggtgtagcgttcagggcgctgtatgcttcaatggcatgggttaacgcatcaatgccggtcatcgccgtgacatgcgacggcacaccttcggtcaatgcggcgtcgaggatcgccacatccggcatcagcgaggcatgggctaacacctgcttgcgcccgctcaccgcgtcgataatcaccgttacattggtggtttcagagccggttccggcggtagttggaatggcaatcagcggcaagcgcggttgcagaacgctggtttctgacatctctgccagcgtgctatccgggttcgtcaccagcaacgtcacggctttcgccgcatccagcaccgagccgccgccaaacgcgatcaccccatcacagcctgactcacgcaactgcgccacggctgcacacacgtcggtaatgcacggttcgcccaccggacatggccagagcgtcatggcgatacctttaacggtcaggctacgcgtcagcccggcggtcatccctgcctgatgcaaaaagctgtctgccatcacgaacagatgtttcagcccacgcgtttgcgcttgctgtccgcaactgctcaccgagcccggaccgcaaagcgtcaccggtggaacgctaaatgtttttacccgttgcagattcagggtatcgaacgcctgaaagagcgcggtctgcaattcattttgcatatagcccctccgctttctctcgcccactactggcgatcgccagcggggtcataaacaaactgtgctgcggtaaatgcacctgtaacgccgggaattgtttgcgaaacagttccgccacgcccggttgcatacaagagccgcccgccagccataaatcagtaatgccctgcccttcaatatgccgggcgacaatgtccgccattttttcgtacaccggtttcaccgcaggccaaatctcttcaccgtgaccgcgcttgtactgctccgcctcttccagcgaaatacggcgatttccggcgagagtcagagagatgtgatgtccgccggtggcttcatccgccgagtacgtcaccttgccctttttcacgatggcaatgccggtagtgccgccgccgatatccactacaccggcgttgtccagttgcagcagatccgcaactgcggttggctcatccagcacatggctcacttccagtccggcagattccagcacgttgatggaaatacgcgggtccgtacctggaggaaatgaagtcgccgcatggctaaaacgacgaccgaattgctgctcgagcgtgtcgagatggcgacgaacaatggtgacagcgccgaagaaatcccagacgatgccgtcgcgaaccacatcggcccagtcgaggcataccgccactggctgaccgtcgcggtcgacaaccatcgacaccacatcgcaggtgcccagatccacccccagccacagcggagattccgtcgcggcgggcgtctggttacacagcgttgccgccgtttgcagacgtggggtgagccattgttcgtcgtgcgccatctgttactccttaaacaatgcgaaacgcatcgactaatacacagcgacgcagacggacaaacgtacgcgcgctggttaccccttcaccggttggcgtggtgatggtcatggtggtccagccttccccgcccagccccagcccggcaatgcacggtccgttcttaacgaaaatgctggtatcaatagcattcgccatctggttcatgttttcgatgttgcgcgagtgcattgccgccgtgtggtggcaaccgccttccagtttcaccgctagcgcaatggcatccgccacgttggcgacgcgcacgacgggcaacaccggcatcatcagttcagtcacggcaaacggatgttctgcggtggtttccacaaacagcaggcgcgtttcttgcggaactttaaggccgattgccgccgcgattttgcctgcgtcgcgaccaacccagtcacggctgacggtgccttttccgcgctcgtcgatatttttcagcaacaccggttgcagctgctgcgcctgttctgcggtcagtttcaccgcgtgctggccttccatcagacgcatcagttcatcggctacgctatcaacaacaatcagtaccttttcgtcggcacaaatgatgttgttatcgaaagaagcgcctttgacgatggactgagcggcacgggcgaggtcggcggtttcatccaccactaccggcgggttgccagcgcctgcggcaatcagacgtttattggtgtgtttacgcgccgcttctactaccgcttcgccgccggttaccaccagcaggccgatacccggaaacttgaacaagcgttgcgcggtttcgatatccggatttgccacagtaaccagtaagttttccggcccacctgcggcaacaatcgcctggttgagcagcgtaatcgcccgctgggagacttttttcgccgccggatgcggggcaaaaatgacgctgttgcccgcggcaatcaggctgatggcgttgttaattacggttgccgccgggttagtggaaggcgtcaccgaagccaccacgccccagggtgcgttttcaattagggtcaggccgttgtcgccagtcagcacttgcggagagaggcactcaacgcctggtgtgccgcgcgcctgagcgacgttttttgcaaatttatcttcaacgcgccccatgccggtttcactgacggcaagttccgctaaatctctggcgtgtttttcgcctgcttcacgaatggcagcaatggctaactggcgcattgccacgctttttaacccttgctgggcgactttggctgccgcaacggcgtcatccagggacgcgaaaacgcccatctcatgaacggcggcggacggcgtgtcactgctttgcattttcagcagtaccgctttcaccacctgttcaatatcctgttgattcatgatgttctgccttatttgtggaaaattacctgaccgccagacaccacctcatcgacaatgccaatcacgcacagatcgaccggtgacgtttcgcttttatgcgcctggcgggcggaactgccactcaccagtaacacccactccccggttcccgcgccaatattgtcgatggcgacggcgcattgcccgtcaggattaccttgtggatcaatcatttccaccatcagcaatttgtcatgcgccagtccgtgatggcgtacggtacaaacaatttgtccagtgacgactgccagtttcatacccgcctccgtggcgtatttcaggtaaaagctccccctaccctccgcagaaggtaaaatgaaaaaggagagagcgtgacgcccgaatcgacgtcacacagggtgattacaggttgctgctatcgcctttcaggccgatcgggaagacttcttccaggtcgccgtgcggacgcgggataacgtgtacagataccagctcgccgatacgctgtgccgctgcggcacctgcatcggtcgcggctttacaggctgcaacatcaccacgaaccatggcagtacacaggccgccgccaatctgcttaacaccaaccagcttgacgcgcgcagctttcaccatcgcgtcagaagcctcaatcagtgcaaccaggccccgggtttcgatcattcctaatgcttccattgtgctttcctctttatcagggtccagaacgggaccgttcattcaaccagtgtttgtaaactgctttcgcggttcacttctgtctgacgcggcacagctgccaccagcgccagctcgataatttcctgcacgctacaaccacgagagagatcgtgcatcggcgcggcaagtccttgtatcagtggcccgacggcacgatatccgccgagtcgttgtgcgattttgtaaccaatatttccggcttccagcgacggaaaaaccatcacattggccttgccctgtagcgggctggcaggcgctttttgcgccgccacttccggcacgaaggcggcgtcaaactgtaactcgccatccaccaccagctttggtgcgcgctcacggacgatttctgtcgcctgctggacgttagcaacacaggggtgacgggcgctaccattgctggaaaacgacagcatcgccacgcgcggctcttctccggtgatggcgcgccaggtttcggcactggcaagcgcgatatccgccagctgcgccgccgtcggctgtggcaccacgctgcaatcggcaaagcccaacgccgggccgctgtactgtggcaacatcaggaaaatggaagagagcgttttacagcctggctgcaagccgataatgcgtaatccggcacgcagcacatttgccgtggaagagaggttgcccgcgatacagacatccgctttaccggcgctgaccattgctgcggcgaacatcagagggtcggtaagtttttccagcgcatccggcggcgttttttcgcccgcgcgggccagccagcgatgagcaaattcttcccgcattgcgaggttgccatgcggatcaatcacctgtagcccgtccatcgccacgccgtgactgagcgcaaactgacgaagttcaaacggattggcgaccagaatgggcgttgccagaccttgttgatgtaaatattgcgcggctttcagcacacgttggtctaacgcatccggaaaaaccactctggcgggcgctcgcaacgccagttcacgacaacgttcaataatcattgcgtttcccccagtcgttgttggatctgcttcaccgttagcggctgcttcgttacgctcaggatcatcatcacgtagaccgtgctcgaaaggcggttcagcgcctgcaaaatgtccgggcgtaatacttcaaagctgcgggtgataaagacctgcgccgctacggtttcggtttcccgcactttggtgcgtagcagattgagcaacgcagcatcgcgcccgtggctggcttccggcaccagatgatcgtggtcgagatagcgcagcggctgatgagaaagccgatgcagatcttcgtcagaaagcccgacaatcgcctggcagcccagcggttcccccagcgcatcggcgcgcataatgttgccaagacgcgaacggatatccgccagccacggctgccacggttccgccagttcaatttgcagccacactgccagcgcaatggtgctgtcgagaaccgcgcgaaaacccagacgcggatcgcttttggcgaccattttttccgccgacaggtgagtcagcgtatccggcttttttgccaccggctggcgacacagttcgcagcacgcctgcggatgttcatcgctactggtcagcccatgaacgggctgcggctgctgctgttcatcgtcaacaaacaggcggccctgctcgtcaataaacttgatgcgcagatggcggctttccagcaactcccgggcagagggcgtcaggcgactgtccgcagggagatggatctctgcgccttcgctgagcgtatggttcgctcttagccatgcttcggtgatgaaatctttcatagggattgccagttagccggccaggcgacatacaggaatttcacgctggatgtcgtaccaaattcgatgctggagcctttcgggataaacatcacgtcgcctgctttggcgatcatggtttggccttcgtggcgaacatgcagctccccttccagcaccatgtcgatttcgtcgtagttcagggtccacgggaagaatgcgttctcccactgcataaaaccggcggccatgctgctgccgtcgtctccggtcacaagatcagtcaagcccacgcaatgcggctctgcgccgtcgaaacgaccaaacttgacgctactgccatcaatcactttgatgccgcctttgccggtcaccgatttgaagctcggctgcattgcgccctgctccagcgactgtttttccttcatcactttttccatcagctgtgcgaccaggctttcggtaaactggccttccggcagctgggcaatgatggtttcgcggatgcgctggctttcggttttgtcggctggcacgctggcgggcacggacgccgttaccgggatcgattcatcacattcggtgatggtaaaacccagtagatccgccacttcacgggcttccggggtaataatgctggcgcgcagaaccacggacattgcctgttcgccgcgcgcgtgtgcttcacgaatatcattcgctgtgatgagttttttcacctgcttcctcctgtttggtgagagatgccagataatccaccagttgctgcacgctttgcgggtcgtggctgtttagctcgaacatcggctcttcgaaacccgtctcaagcaataactttcgcgttgcggcgacgtcagcatctggcatgtccgttttactgatgacggcgatttgccgtttgctgacgccaatatccagcaacccggcaggcaaccgactttccgggtcatttgcgccatggacatagatcagcatgtctacatcctgtagcgtggtaattaaggcgtgataccagcggggatggttaaaatattcacccggcgtatcaatatcgcccttatcattaaattccacggcctgtgtttttctggcgagggtataattcccctgcaacgcattaaataacgttgtttttcctgccccgacgctacccacaaacgcaattcgtttcatgaatgcctcgtattaacttttggtcatttcacaaagcgtataatttaataagcgacctaaaccgctgacggtttgtgataacgcttcttctactgcgcccaccgagccataaatcaccaatgcaccgctgaatcggtcgagaaaaccgatatgcacatcagcggctttcagcgctaaatcaccggcgatcatcgccgtttcgccgggagttagcgtcataatgccaattgcgcccgcatccggaacgccgattttcttcgccagttcctcaccgggatgcgcgatgagatgcgccagtgtgacctgtttgccgggcacaaattcctgaatgatgcgttctttatccatgagtcgccgcctgtgaaaaactttcgtgtatcgtgacaatttttcgtcagagtaaataacaaaattcggcaagcgcgtttaaaaggtgaggtagatcactaagaatggagagatattcgctgtggtgcataaactttcatatgcaacgcatgaatataaataaaataatatcgagatattatatagactgcttttttttattattcgcaaactcagtaataagctttactaatatattgcagctaaactgcttaccctgaatattcagggtaagcgtgagagttaaaaaaaattacagcggttgggtttgcgcttctaccacggccagcgccaccatgttgacgatacgacgcaccgatgcgatcggcgttaacacgtgaaccggtttcgccacacccatcagcaccgggccgacagtcacaccttccgagctggaaacacgcagtaagttgtaactaatgcgggcagcttccatgttcggcatcaccagaatattggcggaacctttcaaagagctgtccggcatacggtcgttgcgaatcgcttccaccagcgctgcatcgccgtgcatttcaccatcaatcatcagttctggtgcacgttccctgaccagttccagcgcctgacgcattttgctcgacgacgggcagtcagaagaaccaaagttggagtgcgacaacaaagcaacgcgcggctcaataccaaaacgacggacagtttctgccgccatcaaggtgatctccgccagctcttctgcatccggttcatcattaacatatgtatcggcaataaaggtgttaccactcggcagcagcagcgcgttcatggcacctgcggtgtgaacgccatcgcgataaccaaagacatttttcaccacgctaaaatgttcatgataatcacccaccgtaccgcaaatcattgcatcggcttccccacgctgaaccatgatcgcgccgatcactgtcgggttactgatcagcgcccgctgcgcctgttcctgagtgacgccgcgacgcttcatgatctggaagtattcggtccagtactctttaaagcgcggatcggattcgttattgacgatctcaaaatcaacgcccgctttgatctgcaagcccagtttctgaatgcgcatttcgatcacgttcggacgaccgataaggatcggtttcgccagtcccagcgttaccagttcctgagtggcatgcagaacgcgcgcctcttccccttccggcagaacaacgcgcttcggcgctttgcgagcctgggagaaaatcggcttcataaacaggttggttttgtaaacgaactcagtcagcttgtcgatgtagacgtcgaaatcagcaatcggacgagtcgccacgcccgactccatcgcggctttagcgaccgcaggagcgatcttaacgatcaagcgcggatcaaacggttttggaatgatgtattccggaccaaagctcagatcctgatcgccatacgctgaagccaccacttcgctctgttccgcatgggcgagttctgcaatcgcacgtaccgccgccagtttcatctcttcgttgatggcggttgcgccaacgtccagcgcgccacggaagatgaacgggaagcacaggacgttgttcacctggttcggatagtcagaacgaccggtgcaaatgatggcatccggacgcacttctttcgccagcggcggcagaatttccggttccgggttcgccagcgccaggatcattggcgcacgagccattttcttcaccatttcctgggtcagcactttcgggccggaacagcccaggaaaatatccgcgccttcaatcacatcatcgagggtacgtttgccgtcatccaccaccgcatatgcggctttggtttccgccatgtttggctcacggccctgatagataacgccttttgaatcgcaaaccacgatgttatgtttttgcagacccagcgctaccagcaggttcatacaggcgattgctgcggcacccgcgccggaaaccaccatccgcacgtcggagatgtttttctccaccacgcgcaagccgttgaggatggcggcagtgctgataattgccgtgccgtgctgatcgtcgtggaataccggaatattcatccgctcgcgcagtttctgttcaatatagaaacattctggcgctttaatgtcttcgaggttgatgccgccgaaggttggttcgagcgcggcgacaacttcaataaatttgtccgggtcgagttcgtcaacttcaatgtcaaatacatcaatcccggcgaatttcttaaacagaacgcccttgccttccatcaccggtttgcctgccagcgcgccaatgttgcctaaccccagcaccgccgtaccgttagagatcaccgccaccaggttacctcgggcggtatatttgtaggcttttaacgggtctttttcgatttcaagacaaggtgcggcaacgcctggtgagtaggccagcgccagatcgcgctgtgttgccagaggcttggttggagaaacctggattttccctggaactggaaattcatggaaatcaagtgcactttgttttaactggtcatccatttggttgttcctttcacgtaacgttcacaaataaagtgtgtgggcaacagcccctgcccacaacgtggcgcacattattaccctgccggagtctacagactttgagcaagtccaaactctcaccattaatataatgttttggtaataatcctataacactgatgttacctgcttaatccagcaataccatgcctgtctgctatgcttttttgatgcgtttagcgaaatttctcagaagtgtgaattaacgcactcatctaacactttacttttcaaggagtatttcctatgaacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaagcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataaaccagccacggagtgttatatgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctgatggtgattgccggatgctgattgccggatgcgacgctgacgcgtcttatccggcctacagcgtcttatccggcctacatgtcccgccattttgtttaacgggtgatccacaacgtgggccaggcgtctggcccatgccagttatcgcaggtgggttctgcggcgtaacgcaccaggcgaaaacgctgaccgtcaaagcgccagcgcgcctgaatgccacaatcgcttaatccgcgccctttcgctaaggtcaccagttcacgcgatttctcatcaaatgttgcgttcatcagttccagttcattcgtctcctgaccgttgttgaacggcaaacgcaaccgaaccgggcgcgaagctagtggctttttacgcgacacaatccatgccaaatcaatggtgttataggcccctgcctcacagctaatcatcatcagcgctttatcatcagtcagcgcagtgacattcacctcacgacgcaatggatcaagcgagcagcgcagaccattcatccgccagtttccataatccagcaaatcgttgcgttcttcgagtgagagtggcgtcggcgttgggttaaccaccgcgacctctttcagcgcaggcgcgggcggtacgctgagcggcggttcgtcccctttcttgatccacgcggtttcactgccaacgcgcttttgctgagcatcaataaacaacaacgctgcttttaagccactcagagaaatggtctgatcgccatcgcgtaaggtgattgccttcccttcctgaatcatctgcaaaaacgcggtgatggttgccgtatcatcggttactaataaccatggtgaaatccgccacttgtcaccacttaacgccaacggctcgccatctaacagcagccgtggcgctatctccccttctgacgcctccggcgacttcaatccgccgcgctcaatacgtaaaacggcatcggtatgcgccccggcgctgcggctcagggtcatcaccagtccattatgatcgcccgtattacgcgccacgcagaaattttggttattacaggtgacctgccagtcggaaaacgcccgttgcgctggtgccgcccacaccaaagacgtcggcaacaaagcgaaaaaaaagagaaggaaaatgcgatagcgcatggacggtacgaccccagaagttcaaacaaacagcacaagtcgtatcttcgttgcgcaggtagcgcggctcaatcggatttgtcggattgagccaataataaacaacgaaatattattgttatttttcagtccattaaatgtgacgtttgcaaatagttaagcaataacaccgtcttaccgtcacgtatctcgccggttttgatcatctccagcgcctggctgaacggcagctcgagcacttcaatatcttcatcttcgacaccgccaccggcgttagcgcgctgattgtcactgtattcggcgataaaaaagtggattagctcagtcacaccgcctggcgacatatacagttcaaataatttgcgcacttcacccacttcatagcccgtctcttcaatcgcttctttgcgaatacacacttccggttcgtcgttatccagcagcccggcgcagctttcaatcagctgcccgctttcattgccattaacccaggtagcgacacggaactgacgaatcagaaccacggtctttttcttcgtgttgtacaggaggatcgtcgcaccattgccgcgatcgtacacttcacgtttatggcggataacttcgccgtctttgcgcgtgagatcgtaagtaatgttgtgcagggtgaaatagttatcggagagaattttgtctttaatgagggtgatttgttgcgtcataccgactccacagcgcgaaatgaacaattatcttacgctgtgaagtcgggtttgtctgcgcaggctatcagtgagatttgactgattttacccccagccagtcaataatcccctgtgccgcatgacgtccttctgccattgcggtaaccaccagatccgcaccacgcacggcgtcaccaccagcgaagattttcggattggtggtctggtaacggtactggctttccacatccgcgatgatgcggccccatttgtctaccgttacaccgtgcgactccagccacggcatcccgtgcggattgaagccaaacgccataatcaccgcgtcggctggcatgacaaattcactgccttccaccggcactggacgccgacgcccctgggcatccggctctccaagacgcgtgcgcaggaaacgaatcccgcagacgtgaccttgttcattcagctcaagcgccaccggctggacgttaaattcgaagttggccccctcttcgcgggcgttcttcacttctttcttcgagcctggcatgttagcttcatcacgacgataagcgcaggtgacgttactcgcgccgtggcgcagtgcggtacgcacacagtccatcgcggtgtcgccgccgcccagtaccacgacgttaagtccggcggtattgataaacggctcttccggtagctcttcgagccccatcacctgtttagtgttggcaatgaggaacggcagcgcgtcataaacgcccggcgcatcttcattgggtaaacccgctttcatggaacggtaagtgcctacgccaacgaagaccgcgtcgtattgttccaaaagcgaatccaaagagacatctttacccacttcacaattgagttcgaagtgaatccccatcgcgctgaagatttcccgacggcgtgccagcagggatttatccagtttgaaagaaggaatgccgaaagtgagcaagccaccgatttctggatggcgatcgtacaccgtcacccccacgccattgcgggtcagaacatccgcacaggccagccctgccggacctgcaccgataatcgccacccgcttgtccactttggtgacatggcttaagtcaggacgccaacctttcgccaacgcctgatctgaaatgtagcgttcaatgttgccgatagttaccgcgccgtgctcatcgcgaatagtacaggcaccttcacacaaacggtcttgcggacaaacgcgtccggtaatttccggcagggtgttggtctggtgagaaagctcgacggcggcgtcgatgtttccggctttcaccagttcaatccactgcggtatatggttatgcagcgggcaggtccattcacaaacgctgtgctcgccgcacttaaggcagcgcgaggcttcccgttgtgcctggtcggcgcgaaatggcagataaatttcatcaaaaccggttttgcgcgcttcaatcgccagtttatccggctcgccacgcgcgggcgttgcctgcatttgttcgactttactcattaccggcatttcttgcgccgcggtactggcatgccacggttgatgttcctgacgcgcggtgcgcaagcggcgggatttcgccatgccggagagtgcgacgtcagtgaccagttgcagcgcgtccgccgggcaattctcaacacaggcaggaccgttttcgcgccccgcacaaaggtcgcatttatgcgccgtggcttttacttttcctgccgcgacgggtgtcaggacgatttgcatcgtaccaaaaggacaggccaccacgcaggatttacagccaatacacttttgctgattgacctgaatgctgtcatcaacgtggctgattgcgccattagggcagctacgggcgcagggcgcatcttcacaatggtgacaggtcactgcactacgttgctgttgatgtttgataaccgtaattcggggatgaaaatggtgttggctcaggacatgttgctcatcattgtgagccatgacacaggcgatttcacaagcatgacaacccagacattgctgactgttggccataataaaacgattcataacgaccttcttttttggttgtaaaaaccttattctttatatgagtgttgttattacccgacttacaggggaatcggcaatgttcatgtgcccagaataagtaactatttcgctataaactgtggcagatcaaataatcccatcactgactaaattgcgtttcagcgaactggaacattaatgattttttgtggagaagacgcgtgtgattgttaaacgacccgtctcggccagtctggcccgggcctttttttacattgtgctgctgtcgattctttccacgggtatcgctctgctaactctggcgagcagtttgcgcgacgctgaggctatcaatattgccggatcgctgcgtatgcagagttaccgcctgggctacgacttgcaaagtggcagtccacaactcaatgcacatcgccagttatttcagcaggcactgcattcaccggtattaaccaacctcaacgtctggtatgtgccagaagcagtaaaaactcgctatgcgcatctgaatgccaactggctggagatgaataatcggctcagcaagggcgatttgccgtggtatcaggccaatattaataattatgttaatcagatagacctgttcgtactggctttacagcactacgctgaacgcaaaatgctgctggtggtggcgatttccctggctggcggcatcggtattttcacgctggtcttttttactttgcgccgcatacgccatcaggtggttgccccgctgaatcagctggttaccgccagtcagcgtattgaacacgggcagttcgactcgccgccgctggataccaacctgccgaatgagcttggtctgcttgcaaaaacctttaaccagatgtcgagcgagctgcataaattgtaccgttcgctggaagcgtcagtagaagaaaagacccgcgatctccacgaggccaagcgtcgtctggaggtgttgtatcagtgttcgcaggcgctgaacactagccagattgatgtgcattgtttccgccatattttgcagattgttcgcgacaatgaagcggctgaatatctggagttaaatgtcggtgaaaactggcggattagcgaagggcaaccaaacccggaattgccgatgcagattttaccggtgacaatgcaagagacggtttacggcgaactgcactggcaaaatagtcacgtttcatcatcagaaccgctgcttaacagcgtttcgtcgatgctgggacgcggtttgtactttaatcaggcgcagaagcattttcagcaattattgttgatggaagaacgtgcgaccatcgcccgcgaattgcacgactcgctggctcaggtactttcttacttacgtatccagttgacgttactgaagcgttcgataccggaagataacgccaccgcacaaagtatcatggccgatttttcccaggcgttgaatgatgcttatcggcagttacgcgagctgttgactactttccgcctgacgctgcagcaggcggatctcccctccgcattgagggaaatgctggatacgttacaaaatcaaaccagcgccaaactgaccctcgactgccgtctgccaaccctggcactggatgcgcaaatgcaggtgcatttgttgcaaattattcgcgaagcggtgctgaatgcgatgaagcacgccaacgccagcgaaatcgccgtcagttgcgtcaccgcgccggacggcaatcacacggtttatatccgtgataacgggattggtatcggtgaaccgaaagaacccgaaggtcattatggtctgaatatcatgcgcgaacgcgcggaacggctaggtgggacgctgactttttcacaaccttccggcggcggcacgttagtgagtattagctttcgctctgcggagggtgaggaaagtcagttaatgtaatgcctcctactgaccaaagaatacttgcacttaaggttcagtataaaagggcatgataatttacattaactcctttttttctccacgattggctcgtaccttgccgctacagtgaagcaagtcaagcctacaacgatacgcagaaacacgaggtcctcttttaatggcgaatttctttattgatcgccccatttttgcctgggtgctggcaatcctgttgtgtctgacaggtaccctggcgattttttcattgcccgttgaacaataccccgatctcgcgccaccgaatgtgcgagtgaccgctaactatcccggcgcatcggcccagacgctggaaaacaccgtgacccaggttatcgagcaaaatatgaccggcctcgataatctcatgtatatgtcatctcagagcagtggcaccggtcaggcatctgtcactttaagttttaaagcaggcaccgatccggacgaagccgtgcagcaagtacaaaaccagctgcaatcagccatgcgaaagttaccgcaggcggtgcaaaatcagggcgtgacggtgcgtaaaaccggcgataccaacattctgaccattgccttcgtctctaccgatggttcgatggataaacaggatattgctgattatgttgccagtaatattcaggacccgttaagccgcgtgaatggcgtcggggatatcgatgcctatggttcgcaatattccatgcgtatctggctggacccggcgaaactcaacagtttccagatgacggctaaagatgtcactgatgccattgagtcacagaacgcgcagattgcggttgggcaacttggtggtacaccttccgtcgataagcaggcgctcaacgccaccattaacgcccagtcactgctgcaaacaccagaacagttccgcgatatcaccttgcgggtcaatcaggacggctcagaggtaaggctgggcgatgtcgccaccgtcgaaatgggggcggagaaatacgattatcttagccgcttcaatggtaagccagcctccgggctgggggtaaaactggcctccggcgctaacgaaatggcgacagcggagctggtgctcaatcgtctcgacgagctggcgcagtatttcccgcatggactggaatacaaggtggcgtatgaaaccacctcgtttgttaaagcctccattgaagacgtggtgaaaacgctgctggaagctatcgctctggttttcctcgttatgtatctgttcctgcaaaacttccgcgccacgctgatacccactatcgccgtgccggtggtgttgatgggaaccttctccgtactttacgccttcggttacagcgtcaacaccttaaccatgttcgcgatggtgctggcgatcggtctgctggtggatgacgccatcgtggtggtggaaaacgtcgaacgtattatgagtgaggaaggactcactcctcgcgaagccacacgtaaatcgatggggcagatccagggggcactggtcgggattgcgatggttctttcggcggtatttgtaccaatggccttcttcggcggcaccaccggtgccatctatcgccagttctctattaccattgttgcggcgatggtgctgtcagtactggtagcgatgatcctcactccggctctgtgtgccacactacttaagccactgaaaaaaggtgagcatcatgggcaaaaaggcttttttgcctggtttaaccagatgtttaaccgcaacgccgaacgctacgaaaaaggggtggcgaaaattctccaccgtagcctgcgctggattgtgatttatgtcctgctgcttggcggcatggtgttcctgttcctgcgtttgccgacgtcgttcttaccgctggaagaccgtggcatgtttactacctcggtacagttgcccagcggttcaacgcaacaacagaccctgaaagtcgttgagcaaatcgagaaatactacttcacccatgaaaaagacaacatcatgtcggtgtttgccaccgttggttctggccctgggggtaacgggcaaaacgtggcgcgaatgtttatccgcctgaaagactggagcgaacgcgacagtaagaccggcacctcgtttgccattatcgagcgtgcaacgaaggcgtttaaccaaattaaagaagctcgcgttatcgccagcagcccgccagcaattagcggtcttggtagttctgcaggttttgatatggagttgcaggaccacgctggagcgggtcacgatgcgctgatggcagcacgtaatcagttgctggcgctggcggcggaaaacccggagctaacccgtgtgcgccataacggcctcgacgacagtccgcagttgcagattgatatcgaccagcgtaaagctcaggcgctgggcgttgctatcgacgatattaacgacacactgcaaaccgcctggggttcgagctatgtgaatgactttatggatcgcggtcgcgtgaagaaagtctatgtgcaggcagctgcgccgtatcgcatgctgccagatgacatcaatctctggtatgtccgaaataaagatggcggcatggtgcccttctctgctttcgcgacctcacgctgggaaacaggctcgccgcgtctggaacgctataacggttattctgcggttgagattgttggggaagccgcaccgggggtcagtaccggtacggcgatggatattatggaatcgttagtgaagcagctgccaaacggctttggtctggagtggacggcgatgtcgtatcaggagcggctttccggcgcgcaggctccggcgctgtacgccatttccttgctggtggtattcctgtgtctggctgcgttgtatgaaagctggtcggtgccgttctcggtaatgctggtcgtgccgctgggggtaatcggcgcgctgctggcaacctggatgcgcgggctggaaaacgacgtttacttccaggtgggcctgttaacggtcattggtttatcggcgaaaaacgccatcctgatcgtcgagtttgctaacgagatgaaccaaaaaggccacgacctgtttgaagcgacgctccacgcctgccgtcagcgtttacgcccgattctgatgacctcgctggcatttatcttcggcgtattgccaatggcaaccagcacgggtgccggttccggtggtcagcatgcggtgggtactggcgtaatgggcgggatgatttcggccactattctggctatttacttcgtgccgctgttctttgtgctggtgcgccgccgcttcccgctgaagccgcgcccggaataagcaataaaaaaggcgacatgccaatgtgtcgcctttttcaactttccgattaagaacctgctcagcgggttcttgctgtttgtactttgtctcaggaattacttacgaagcataacttcgataaagtctttccagttccccagttcacgttcaatcataacaacctctcttataattatgggtattctacggaaacaatataccgtggtgaagctaatttactcgattgctgcgatgactacctccgggggacaaatcttatgtaaatactatggtcctgcggtgatgatttgtatgtgatacacagcaacatttcgagatattcatacggcatctaatactgatttaattctggttaaaatacagacagataacaagatgaatattcttaatgtttacgttaaaaatgtttaatattatttaatagttgttaatttgaatacttcgataatgttatatttcctgataatcatttgcaggcaaaatgttttcacccttaaatgagtatttattctcataaatcgaaaaaggattcattatggttacactttacggtatcaaaaattgtgacaccattaaaaaggctcgccgttggctggaagccaataacatcgactatcgttttcatgattaccgcgtcgatgggctggacagcgaattattgaacgattttatcaacgaattaggctgggaagcgttactcaacacccgtggtacaacctggcgtaaactggacgaaaccacccgcaataaaatcaccgatgcggcctctgcggcggcattaatgactgaaatgcctgcaattatcaaacgtccattgctctgcgtgcccggtaagcctatgctgctgggtttcagtgattccagttatcagcaatttttccatgaggtgtagtctatgtcgtgcccggttattgagctgacacaacagcttattcgccgcccttccctgagtcctgatgatgcaggatgccaggctttgttgattgaacgtttgcaggcgatcggttttaccgttgaacgcatggactttgccgatacgcagaatttttgggcatggcgtgggcagggtgaaacgttagcctttgccgggcataccgacgtggtgccgcctggcgacgccgatcgttggatcaatcccccgtttgaacccaccattcgtgacggcatgttattcgggcgcggtgcggcagatatgaaaggctcgctggcggcgatggtggtggcggcagaacgttttgtcgcacaacatcccaaccatacggggcgactggcatttctgatcacctctgatgaagaagccagtgcccacaacggtacggtaaaagtcgtcgaagcgttaatggcacgtaatgagcgtctcgattactgcctggttggcgaaccgtcgagtatcgaagtggtaggtgatgtggtgaaaaatggtcgtcgcggatcattaacctgcaaccttaccattcatggcgttcaggggcatgttgcctacccacatctggctgacaatccggtacatcgcgcagcacctttccttaatgaattagtggctattgagtgggatcagggcaatgaattcttcccggcgaccagtatgcagattgccaatattcaggcgggaacgggcagtaacaacgttattccgggtgaactgtttgtgcagtttaacttccgcttcagcaccgaactgactgatgagatgatcaaagcgcaggtgcttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccactattcataaaattaatgaatgtgtgaacgctgccgacctgcagctacttgcccgtatgtatcaacgtatcatggaacagctcgtcgcctgatgagtggttctgcaagaggaaataagcatggactggctggctaaatattggtggattctggtgattgtctttttggtaggcgtcctgctgaacgtgattaaagatctcaagcgcgtcgaccataagaaatttctcgccaacaagccggagcttcccccgcatcgtgatttcaacgataagtgggacgatgacgacgactggccgaaaaaggatcaaccgaagaagtaagctgagtgctcaaccgtaggccggataaggcgttaacgccgcatccggcaatggtgaacgatgcctgatgcgacgctcacgcgtcttatcaggccaggtaatctgtcttttacatcatttcaatcacatcatcatcgccaggcttaccgccacttagcgcttcgtcgaaataatgtttcggaatggtataacgcaagtgatccagggcaaattgcatactgcgattgtcgatcgcatggcctaaatcctccacgatatccagcgtcacgtcaccaccggcactgattaacgcttcctgcgccgcaaccgcatgcgccagatcgataaccggatcttcaccgccatgaatcaggtgaattgtcgtggctgtagacgcagtttccggcaggctcgcatagcgtccgttaaaagcaatgacgcgtgaagcaaggcccggttcggctttaatgctctccagcaccataatcgcgccttgagagaaaccgatgagcgccgtggcgttagcccctactccgctctgtttctgccagtagcgcaccgtttcaataaacgtcggcatgatcgcatccacacgcgcctggcgattatcttccgtaataccctgcaccgaaaaccactgacgccccgccggattaccgctcggctccgcgccaccgacactcaccaccagcgcatcaggaaacagcggtgcaaaccagttgcctatttcccccattgccaccgggttatccccgacaccgtggaaaagcagtaacaactgttgcgcaggtttatccgggctttgaacaacaaaatggtcatgtttcatggcgaactccttaactgatgtcattaattttacgccgctgactcacaatgaccatgagataaaattgaaggagtcagtgaaataattgccattgcgttatgcgatcgcgcagacgctcagtgcgaacatcattaagtgcgaacagcgcctgcgcggcctcttcccgctgacggaccagtaacatcttgcggcctgaaagtttaagtgtggtacataactgcgcatcactggcgtttttctgtaaacgcccacgcagcgccggtaatgccagttcactggtttgtaacagacgcaataagcaacctaacgacgttaatagcggacgatgagcgaaagcaaaaccggccagttcaagccagtcgtcgtcagaaaggacggcatcgtttagtggatcaacaggaagcgtttcgccattccactgcgcgagagcttgcgcatcgcgacgtaaacggtaatgctcacgttcagccagctgtttacccgcatcactcatcggtaacagcgccatcgccgtatagcaaccgctgctggcttcccgatgattacccatccgcaccagcacaaaaccgcagcgttgccagaaacgccataactccccggtgtaaccaaaactcaccgaaagatagtcgaggtcttgcgtatattgcaaagcaccagcaataagttgccgccctgtgccttcccgctgacgagccggatgaactgctatccggctgacccgccgtccacgcaatgtcgccgccagtggattgttgccgtgcgccgccagcgactgggccaccagattaccccgcgggcgacgaaaacctgcccataccgcctgactgagttgttgagataatccaccctcatccaccagccacagcgccccggcaatctcgttttcgccagccgcctgtaaaaaatgttgccctggtgcatccatcatccggcgtaaatccagcggcgaagtccgatagtgcgcaccagacaagagctgataaacctttaacggcgtttctggatcgctttgccataacgtctgttcaaatgcggaaatgacaatattgccttgtggtgtatgggtgaagttttcatcgtcaaaaaccagtgcctcgctgaccattttttccagcgggcatccctgcgcccagcggatcggctgttgcagttcaaaacggtgtaaatgcggaaagcgagcgcaaaatttcagcaaaaaaccacgtccggtgccttcgtagccctgcaccgtagtggttaacaacgttcgaggaaaacgcgataccagttgatgcaacaatggcgcaggtatggctgcggcttcatcgaccaccagccagtcggcttgctcatcgctggctaacaaggcatccggcgcaataaagcgaaacttctcgcccgcaaattgtgccagtacatccgttgacgcttttgcgggcgcggtgacaatcgctctgcccgcaatacgagaaatgagttgccctgccaacgccgacttaccgcgcccacgcgcagccgttaccgctgccacgcccggcggcatggtcattagctgctttaagagttgctgttgttctggttgtggtgcgccagtcgcggggtaccagtcagtacggggagtaaaatgcgccaacgagaatggctggttttgccgccagaggatagcctcgttatccgccgtaagtacgcgtttgagatgctggacaaaatgcggcgtcgcaatagggtcagggcaatcactccagcgcagcgagtcggcatcaggttggttttcccactcttcccatacagggagtaacaaaaccagccagcttcccgctttcaacgttccgctaagtgcggcaaaggcagcggcatcaaagccgtggcgggcgtcgaataccgcatgccggaactcgcgcccaagtaaagtttgtagtgccgagggagaacagtggttttcagcatctggccgcggcgaaatccacagccagtcgccaggtaaggcatcacgcaacttaagagtatgctcaaaacaccaaccctcttccccgctcaacaccagcaagcggcggatcccttcacgtttcatttgcgctgttaatgtgtgaagcgcagtcagttcagccatccctgccccggaagttaaatgcttttaccaaaagtattgcattgtgccggatcgccgctgtcgaaaccacgtttaaaccagctgtagcgttgctgagaagtgccatgagtgaaactgtctggtactactcgcccctgactttgctgttgtaaacggtcatcgccgatggcctgcgccgcgttcagcgcctcttccagatcgccggtttccagaacgccttgctgctgcatactatgcccccagacaccggcaaaacagtcggcctggagttccatacgcacagataagcggtttacttccgcctgcgtcgcgttttgttgcagttgacgaactttcggctcgatgcctaacagtttctgcacatgatgaccgacttcatgggcgataacgtacccctgggcaaaatcgccatccgcgccaagtttgtctttcatgtcatcatagaaggagagatcgatataaaccgtgccatccgccgggcaatagaacggccccattatggactggcccgccccgcagccggtacgcgtcattccacggtacatgaccagcttcggttgctgataggtcttacccatcttctcgaactgttgtccccaggtgtcttccgtggttgccagaatcaccgaggtgaattttgcggcttcgtcttcatttgggctaattgaccgcgttgattgttgttgggaaaccggctgcccggtcatcaacccggttaaatcaacaccatagtagcctgcaaccagcacgactatcagtaaaatcagcccgcctttaccgcttggcaggcgaaaaccgggaccgcccatagatggaccaccagagctgttgcgcctgtcttcaacattgtcactttcacgtcgcccttgccaacgcatagatacctcaacaatatattcattatagaaatgatcgtaggtggttcagaggaagattaccacaggaaagcgggatgaaatggcggaggaatgagcgttcaatgcatatattccgagagcggttgtcttgccgtgccagctgcacggcaagatgatgaacagaaaaatcagtccagctgtacacccaggcggcgggcgacggcttcataggcttcgatcaggccaccgaggctctggcggaaacggtctttgtccattttctccagcgtttctttgtcccacaggcggctaccgtccggggagaactcatcacccagtaccacttcgcctttgtacagaccaaattccagcttgaagtcgaccagaatcagaccagcatcatcgaacagttttttcagcacgtcgttcgctttgtaggtcagctctttcatacgcgccaggttctctttgctcacccagccaaaggtttcgcagtaagattcgttgaccatcggatcgtgcatggcgtcgtttttcaggaacagatcgaacagcggcgggttcagctcaataccttcttcgattccaagacgtttcaccagagagccagcagcacggttacgcacgacacactcaaccggcaccatatccagctttttcaccagacattcggtatcggagagcagacgctccatttgagtcgggatacccgcttcagccagtttgctcataatgaagtagttgaacttgttgttcaccatacctttgcgatcaaactgctcaatgcgcgcgccatcccctgctgacgtatcattgcggaattcgagcaccaacaggtccgggttttccgtgctgtatacggttttcgctttaccacgatacaactcagcttgcttttgcatctttatcactcctgggtgtgaattaacgttttaaaatcttttgctgtctggtgtgccggatgttttgtcggatgcggcgtgaacgccttatccgaactacgtccgacaaacaaatttcgtgcgaattaccgctaaaatcgcgttttcctgcagacgcacacgtttgcgtatcatatcagaaaaaagggccggatgattccagccctgtatttttacttgctaaacgcagcctggaagacagctaccagcgcgtcgttctgactctgagtcagagtatgacctttcggatcgatgaactgtaggctgctgcggttatctaaatcgccaacctgcagtttatagtcaccggatgccaggcctggatcgctcgcgcccagttcctgccagtcgctgtcagacagcggcttataagttacggccatgttgccctgcgaacgggtgctgtcggtcactttcatgcccactttttccagcgccgctggcagacgttgccaaaccacattgaacggcccgcgtacgaccagcattggtaaaccggtgtcatcagctgcactttgtacgtccatagtggtggaggcacgattttgcgcagcgttcgcggcgtcagtggcagatttatccagaccggcggaaataacgttcatcatctccgtgctgtaacgctgcatggaagccgcgtctgcaaccggtttgcccgcctgttccaggttcagcagtttaaccgtaaccgcctgctgataaccctgcggcttaacagagatttgataacgaccacgatactgctcgtcttcgtccagacggttccattgtacccaatcggtggtcagtgtctgaccagcatcatcacgttgggtgatggtgtagtttttcgcctgcagcacgctaaccacctgcggccacagagtattgccacgaccattttccaccagcaatgaagcggtatcgcccgtgaactgggtacgcgcgccagaaaccagtgccagcggctgggctggtggacgaatgtccagcgccttaccgacagcaccactaccgttggtcaccgggattgcataatcaccggaggtcaccggcaaaatcattccagccggggcatgaagctccgcaagcggtgccgcttccaggtaggcttcatcaccactgacctgacgcttatagcgtgagtcagaactacaggcagcgagtaataaaacaagcgaaacacccgcaacctttgccaggcgcgacttttgaacagagtaagccatcaaatctccctaaactttacagcaaaccggcatgcttaagcgccgctctgaccgtctcacgaccactgtcggtgattggtgtcattggcaggcgcagcgtatcggtcgccacaagacccagttccttacatgcccatttcaccgggattggattgggttcgacaaatagtttgttgtgtaatggcatcagacgctgattaataacgcgtgcctcggcaaaatgcccttctgctgccagtttgcacatctgggccatatcacgcgctgcgacgttagccgtaacggaaataaccccatgaccgcccaattgcatgaagtccagcgcgctcgcatcatcgccgctcagcagaacaaaatcatctgaaaccagctctttgatctggtttacacgcgttaagttccctgttgcctctttgattccgataatattttttactttcgccagacggcccaccgtttccgggagcagatcgcagccagtacgggacggcacattatacagaatttgcggcaggtcagtatgctcagcgatggctttgaaatgctgatacaaaccttcttgcgacggacgattgtagtaaggggttaccgtcaggcagccgacgataccactgtcattgaagcgctgcgtcaggctaatggcttccgcagtagcgttagcgccggtcccggcaattaccggaatgcgcccatcagccagatccagcgtcatcatcaccacatcagcatgttcgtcatgatttaaggtagcggactcgccagtggtgccaacagaaacgatcgccgaagtaccgctggcgacatgataatcaatcagttttttcaagctagcccgacagacattacctttttcatccatcggagtaacaatcgcgacaatacttcccgtgaacatgggccatcctctgtgcaaacaagtgtctcaatggtacgtttggtatggcattaaaagcaagcagacagaaccgttctgattgttgtatgcatgttttttttatgctttccttaagaacaactcaccccttaaaggaataaccagtttgacactgtcatcgcaacattatctggtgatcactgcgttgggtgccgatcgccctggaattgtgaacaccatcacccgtcatgtcagtagttgcggctgtaatattgaagacagtcgcctggcgatgctgggagaagagttcacgtttattatgctgctttccggttcatggaatgccattactctgattgaatcaacgttaccgttgaaaggtgccgaactggatcttttaatcgtgatgaagcgcacgacggcgcgtccgcgtccgccaatgccagcatctgtctgggttcaggtcgatgtggcagactccccgcatttaattgaacgcttcacagcacttttcgacgcgcatcatatgaacattgcggagctggtgtcgcgcacgcaacctgctgaaaatgaacgggctgcgcagttgcatattcagataaccgcccacagccccgcatctgcggacgcagcaaatattgagcaagcgttcaaagccctatgtacagaactcaatgcacaaggcagtattaacgtcgtcaattattcccaacatgatgaacaggatggagttaagtaatgaatccactgaaagccggtgatatcgcaccgaaatttagcttgccggatcaagacggagaacaagttaatttgaccgacttccagggacagcgtgttctggtttatttctacccgaaagccatgacccccggctgtaccgtacaggcctgcggcttacgcgataacatggatgagttgaaaaaagcgggcgttgatgtgctgggtatcagcaccgataaacccgaaaaactctcccgttttgcggaaaaagagctgcttaactttacgctcctgtctgatgaggaccaccaggtgtgcgaacaattcggcgtctggggtgaaaagtccttcatgggcaaaacctacgatggcattcatcgcatcagcttcctgattgacgctgatggcaaaatcgaacatgtctttgacgatttcaaaaccagcaatcaccacgacgttgtgctgaactggctgaaagaacacgcctgattactttgctccattccgtgctggctgcgcttgcggccagcatacctcacttctcgtgatcaagatcacattctcgctttcccctgcgacacgggtgtcgaatccattttttgctgaacgttaatgaccatcatttttgtaccgttcagaatccagttaatacataacttattgaatatattgagttaatcagaatggcatcctttatgcaatatgaaatgcaatgtttcatatcattttcaaggagccgacatgaaccgctttgtggtggccgaaccactgtggtgtacaggatgtaatacctgtctcgctgcctgttcggacgtgcataaaacgcaaggtttacagcaacacccgcgcctggccctggcgaagacgtcaacaatcactgcccctgtcgtgtgtcatcactgtgaggaagccccttgcctgcaggtctgcccggtcaatgccatctctcagagggatgatgcgatccaactcaacgaaagcctctgtattggctgcaagctttgcgccgtggtctgcccatttggcgcaatcagcgcttcaggaagccgtccggtgaatgcccatgcgcaatatgtttttcaggctgaaggctcactcaaagacggcgaagaaaacgcgccaacacaacatgctttgctgcgctgggaacctggtgtccagaccgtcgcggtgaaatgcgacctgtgtgatttcttgccagaaggtccggcctgcgttcgcgcttgcccgaatcaggcgttacggctgatcaccggtgatagcctgcaacgtcagatgaaagaaaaacagcgccttgccgcaagctggtttgccaatggcggggaggatcccctttccctcactcaggagcaacgctaatggatgccctgcaattattaacctggtcgctgattctctatctgtttgctagtctggcttcgctgtttttactcggtctggacagactggctattaagctttccggcatcacatcgctggtgggcggcgtgattggcatcatcagcggaattacgcaattacatgctggtgtaactttagtcgcccgttttgcccccccttttgaatttgccgatttaaccctgcgaatggatagcctctcggcatttatggtgctggttatctccttgctggtggtggtttgttctctctattcattgacttatatgcgcgaatacgagggcaaaggcgcggcggcgatgggcttctttatgaatattttcatcgcatcgatggttgccctgctggtgatggacaacgctttttggttcatcgtgctgtttgaaatgatgtcgctgtcttcctggtttctggtcattgccaggcaggataaaacgtcgatcaacgctggcatgctctacttttttatcgcccacgccggatcggtgctgataatgatcgccttcttgctgatggggcgcgaaagcggcagcctcgattttgccagtttccgcacgctttcactttctccggggctggcgtcggcggtgttcctgctggcctttttcggttttggcgcgaaagccgggatgatgccgttgcacagctggttgccgcgcgctcaccctgccgcaccatcgcacgcttcggcgttgatgtctggcgtaatggtcaaaataggtattttcggcatcctgaaagtagcgatggatctgctggcgcaaacgggtttgcctctgtggtggggcattctggtgatggcgatcggcgcaatctccgcgctcctgggcgtgctatatgcgctggcggaacaggatatcaaacggctgctggcctggagtaccgtcgaaaacgtcggcattattttgctggcagtcggtgtggcgatggtcggtctgtcactgcacgacccgctgctcaccgtggttggactgctcggcgcactgtttcatctgctcaaccatgcgctgttcaaagggctgctatttctcggcgcgggagcgattatttcgcgtttgcatacccacgacatggaaaaaatgggggcactagcgaaacggatgccgtggacagccgcagcatgcctgattggttgcctcgcgatatcagccattcctccgctgaatggttttatcagcgaatggtacacctggcagtcgctgttctcactaagtcgtgtggaagccgtagcgctacaacttgcgggtcctattgctatggtaatgctggcagtcactggtgggctggcagtaatgtgcttcgtaaaaatgtacggtattactttctgtggtgcgccgcgcagtacacacgctgaagaggcacaggaagtgccaaatacgatgatcgtcgccatgctactgctcgcggcactctgcgtattaattgcgcttagtgccagttggctggcaccgaagataatgcatattgcccatgcgtttaccaatacccctcccgccactgtcgccagcggaatagcacttgtacccggcacgtttcatacacaggtcaccccctcattactgttgctgttactactggcgatgcctttgctgcctggcctttactggctgtggtgtcgttcgcgccgcgcagcgtttcgtcgcacaggagatgcctgggcatgcggctacggctgggaaaatgcgatggccccgtcaggcaatggcgtgatgcagccgctgcgtgtggtcttttctgcgctatttcgtctacgacaacagctcgaccctacgctgaggctaaataaaggtcttgcgcacgtcaccgccagggctcagagcacagaacccttctgggatgagcgggtgatccgccccatcgtgagcgccacccaacggctggccaaagaaatacagcatctgcaaagcggcgactttcgtctctattgcctgtatgtggtcgccgcactggttgtgctgctaatcgctattgccgtctaaggaaatcaccatgagacaaactctttgcgacggatatctggtcatttttgcgttagcacaggccgtgattctgctgatgctaaccccactttttacgggtatttcccggcagatacgcgcgcgtatgcactcccgccgcgggccggggatctggcaggattatcgcgatatccacaaactgtttaaacgccaggaagttgcgccgacatcttcaggtctgatgttccgcctgatgccgtgggtattaatcagcagcatgctggtgctggcgatggccttaccactgtttattaccgtttccccttttgcgggcggcggcgatctgatcacccttatctatcttcttgccctgtttcgttttttctttgctctttccgggctggataccggaagtccgtttgcgggagtcggtgccagtcgcgagttgacgctcggcattctggtcgaaccaatgcttattctctcactgctggtattggcgctgatagcaggttccacgcatatcgagatgatcagcaatacgctggcgatgggctggaactcgccgctaaccaccgtactggcgttactggcctgtggttttgcctgcttcattgagatgggaaaaattccctttgatgttgctgaagcagaacaggaattacaggaaggcccgctgaccgaatattccggtgccgggctggcgctagcgaaatgggggctggggctgaaacaggtcgtgatggcatcactgtttgtggccctgtttctgccctttgggcgcgcgcaagaactttctctcgcctgcctgctgacttcacttgtcgttacgctgctcaaggttttgctgatttttgtactggcctcaatcgcagaaaacacgctggcacgcgggcgttttttactcattcaccatgtgacctggcttggcttcagccttgctgcgcttgcatgggtcttctggttaaccggtctgtaaggagcactgacggaatatggaaaatcttgctctgacgacgttattgctgccttttatcggcgcactggtcgtttcgttttcgccacaacgtcgggccgccgaatggggggttttgttcgccgcgctgaccacgctgtgcatgttgtcactgatctccgcgttttatcaggccgataaagttgccgtcacgttgacgttggtcaacgtgggggatgtggcgttgtttggcctggtcattgatcgcgtgagtacgctgattctgtttgtggtggtgtttctcggtttgctggtcacgatctactccacgggttatctgacggataaaaatcgcgaacacccgcataacggcacgaatcgttattacgcatttttactggtgtttatcggcgcgatggcgggactggtactctcctcgacgctgctcggtcagttgttgttttttgaaattacaggcggctgctcctgggcgttgatcagttattaccagagcgataaagcgcagcgttcagcactaaaagcgttacttatcactcatatcggctcgttggggttgtatcttgccgccgccacgctgtttttgcagaccggaacgtttgcgcttagcgcgatgagcgagttacacggcgacgcacgttatctggtttatggcggcatcctgtttgccgcgtgggggaaatcggcccagctaccgatgcaagcgtggctaccggacgcaatggaagcgccaacaccgatcagcgcctatctccacgccgcatcgatggtgaaagtgggcgtttacatttttgcccgcgctattatcgacggcggcaatatcccgcatgtgattggcggcgttggcatggtcatggcactggtcaccattctttatggctttctgatgtatttgccacagcaggatatgaagcggttgctagcctggtcgaccatcactcaacttggctggatgttcttcggcttgtcgctctccatcttcggctcgcggctggcgctggagggcagcatcgcctacatcgtcaaccacgcgttcgctaaaagcctgtttttccttgtagcaggtgcgctgagttacagctgcggcacgcgcttgttgccgcgtctgcgtggcgtattgcacaccctgccgttgccaggcgtgggtttctgcgtggcagcgctggcgattaccggcgtgccgccgttcaacggcttcttcagtaaattcccgctgtttgctgccggttttgcgttgtcagtggagtactggatcctgctgcccgccatgattcttctgatgattgaatcggtcgccagtttcgcctggtttattcgctggtttggtcgcgttgtgcctggcaaaccgagcgaggccgtcgccgatgccgcaccgctgccaggatcaatgcgcctggtgttgattgtactgattgtgatgtcgctgatttccagcgtaatcgccgcgacctggttgcagtaaggagatgatgaatgaccggttctatgatcgtaaataatctggcgggactgatgatgctgacatcgctgtttgtgattagcgtcaaaagctatcgcctgtcatgcggattttacgcctgccagtcactggtgctggtgtctattttcgccactctctcgtgcctgttcgccgcagagcaactgctgatctggtccgccagcgcctttatcaccaaagtgctgctggtaccgttaatcatgacttacgctgcacgaaatattccccagaacatcccggaaaaagcgttattcggtccggcaatgatggcactgctcgcggcgttaattgtcctgctttgcgcatttgtcgttcagcccgtgaagctaccgatggctaccgggctgaaaccggcgctggcggtagcgttaggtcattttctgcttggcctgctgtgcattgtcagccagcgcaatatcctgcggcaaatttttggttactgcctgatggaaaacggctcccatctggtgctggcgcttcttgcctggcgagcaccggaactggtggaaataggtatcgctaccgacgccatcttcgccgtcattgtgatggtgttactggcaagaaaaatatggcgtacccacggcacgctggacgtgaacaacttgaccgcgctgaagggataatgagatgagttattctgtgatgttcgctttactcctgctcacgccgctgcttttttcgctgctctgttttgcctgccggaaacggagactttctgcgactcgcacggtgaccgtattacatagcttagggatcacactgctgctgattctggcactctgggtggtccaaactgccgctgatgcaggagaaatattcgctgcgggactgtggcttcatattgatggtctgggcggtttgttcctcgccattcttggtgtgattggctttctcaccggtatttactcgattggctacatgcgtcatgaagtggcacacggcgagctttcacccgttacgctgtgcgattactacggtttcttccatctgtttttgttcaccatgctgctggttgttaccagcaataacctgattgtgatgtgggcggcgatcgaagccaccaccttaagctcggcgtttctggtaggcatttacggtcagcgttcatcgctggaagctgcatggaagtacatcattatttgtactgttggtgtcgcttttggtctgttcggtaccgtgctggtatacgccaacgccgccagcgttatgccgcaggcagaaatggcgatattctggagcgaggttcttaagcaatcgtccttgcttgacccaacattaatgctgttggcctttgtgtttttgctaattggctttggtaccaaaaccgggctatttcccatgcacgcctggctgccggatgctcacagtgaagcgccgagtccggtcagcgccctgctctccgccgtattgctgaactgcgcgctgttggtgctgattcgctattacatcattatttgccaagccatcggcagcgatttccccaaccggttgttgctcatcttcggcatgttgtcggttgccgtggcggcatttttcattctggtacagcgggacattaagcgtctgctggcgtactccagcgtggagaacatggggctggtcgcggtggagctaggcattggcgggccgctgggaatttttgccgcgctgctgcacatcttaaaccacagtctggcaaaaacgctgctgttctgcggttccggcaatgtactgctcaagtacggcacgcgcgatctcaacgtcgtctgtgggatgctcaaaatcatgccatttaccgccgtgctgtttggcggcggtgcgctggcgctggcagggatgccgcccttcaacatttttcttagcgaatttatgaccattaccgccggactggcacgtaatcacctgctgattatcgtcctgctgttattgctgttaacgctggtgctggcgggcctggtacggatggctgcgcgggtgttaatggcgaaaccgccgcaggccgttaaccggggtgatctcggctggttgaccacctcgccaatggtgattctgctggtcatgatgctggcgatgggaacgcatattccacaacctgtcatcaggatcctggcgggcgcttccactatagtcctctcagggacgcacgatctgcctgcacaacgtagcacctggcatgattttttgccttcaggcaccgcatctgtttcggagaaacacagtgaacgttaattcatcgtcaaatcgtggcgaagcgattctcgccgccctgaaaacgcagttccccggcgcggtgctggatgaagagcgacaaacgcctgaacaggtcaccattacggtgaaaatcaatctgctgcctgacgttgtacagtatctttattatcaacatgatggctggcttccggtcctgtttggcaacgacgagcggacacttaacggtcattacgcggtttattatgccctttcaatggaaggggccgaaaaatgctggattgtggtgaaggcgctggtcgatgccgacagtcgggagtttccgtcagtcacaccgcgcgtccctgccgcggtctggggcgagcgagaaattcgcgatatgtacgggctgattccggttggcctgccggatcagcgtcgcctggtgttgcccgatgactggccggaagatatgcatccgctgcgcaaagatgcgatggattatcgactgcgccctgaaccgacgactgattccgaaacgtatccgtttatcaatgagggcaacagcgatgcgcgggtgatccctgtcggcccgctgcatatcacctccgatgaaccgggtcacttccgcttgtttgtggatggcgagcaaattgtcgatgctgattaccgcctgttttatgtccatcgcggcatggagaaactggcagaaacgcggatgggctacaacgaagtgaccttcttatcggaccgcgtgtgtgggatttgcggttttgcccacagtgtggcctataccaattcggttgaaaatgcactggggattgaggtgccgcaacgagcacatactattcgctcgattctgctggaagtcgaacggctacacagtcatttgcttaaccttggcctctcctgccatttcgttggttttgataccggctttatgcaatttttccgcgtgcgggaaaagtcgatgacgatggcggaattgctgatcgggtcgcgtaaaacctacggtctgaatctgattggtggtgttcgccgcgatattctcaaagagcaacgtctgcaaacgctgaaactggtgcgcgagatgcgcgccgacgtgtcggagctggtagagatgctgcttgctacgccgaatatggaacaacgcactcagggcattggcattctcgaccgacaaatcgcccgtgatttgcgctttgatcacccctacgccgactacggcaatattccaaaaacactgtttacctttaccggcggcgatgttttctcccgcgtgatggtccgtgtcaaagagacgtttgattcgctggcaatgctggaatttgccctcgacaacatgccggataccccactgctgaccgaaggctttagctataaacctcacgcattcgcgctgggctttgttgaagcgccacgcggtgaagacgtgcactggagcatgctcggtgataaccaaaaattgttccgctggcgctgccgtgccgccacctacgccaactggccggtgttgcgttacatgctgcgcggcaataccgtttctgacgcaccgctgattatcggtagccttgatccctgctactcctgtaccgaccgtgtgacgctggtagatgtgcgcaagcgccagtcaaaaaccgtgccgtataaagagatcgaacgctacggcattgatcgtaaccgttcgccgctgaagtaaggacagaagatgctgaagttactgaaaactattatgcgcgccggaaccgcgacggtgaaatatcccttcgcgccactggaggtcagccctggctttcgcggaaaaccggacctgatgcccagccaatgtattgcctgcggtgcctgcgcctgtgcttgtccggcaaatgcgctgactatccagaccgacgaccagcaaaattcgcgcacctggcagctctatctggggcgttgtatttactgcggacgttgtgaagaagtgtgcccgaccagagccatccagcttaccaataactttgaactgaccgtcaccaataaagccgatctctatacccgcgcgacgttccatctacaacgttgcagccgttgcgaacgcccgtttgccccgcaaaaaaccatcgcactggctgctgaattgttagcacagcaacaaaatgcgccacaaaaccgcgaaatgttgtgggcgcaagcgagcgtctgcccggaatgcaaacaacgcgcgacgctgatcaacgacgatacagatgtactgctggtggctaaggagcagctatgagtccagtgcttacacaacatgtcagccagcccatcacgctggacgagcaaacgcaaaagatgaagcggcatttgctacaggatatccgtcgctcggcttacgtttatcgcgtcgattgcggcggctgcaacgcctgtgaaatcgaaatttttgctgccattacaccagtattcgacgcagaacgttttggcattaaggttgtttcatcaccgcgtcacgccgatattttgttatttactggcgcagtcacccgggcgatgcgtatgcctgcacttcgggcgtatgagtctgcccccgatcataaaatttgtgtttcctacggcgcgtgcggtgtcggcggcggtattttccacgatctctacagcgtctggggcggtagcgacaccattgtccccattgatgtttggatccccggctgcccgccaacaccggccgccaccattcacggtttcgccgtggcgctcggtttgctgcaacagaagattcacgctgtggattatcgcgatcccaccggggtgactatgcaaccgttgtggccgcagatcccgccatcacagcgtatcgccattgagcgagaagcgcggcggctggcgggctatcgtcaggggcgagaaatttgcgatcggctcctgcgccatttaagcgacgatcctacaggaaatcgggttaacacctggttgcgcgatgccgacgatccacgtctcaatagtatcgttcagcaactctttcgcgtactccgggggttacatgactgaagagtgcggggaaattgttttctggacgctgcgaaaaaagtttgtcgccagtagcgacgagatgccggaacacagctctcaggtaatgtattactcgctagctatcggccatcacgttggcgtgattgattgtctgaatgtcgccttccgctgcccactgacggaatacgaagattggcttgcactggtcgaagaggagcaagcccgacgtaagatgctgggggtgatgacttttggtgagattgttattgacgccagccacaccgccctgttgacccgggcattcgcgccactggcggatgacgcgacgtctgtgtggcaggcgcgtagcattcaattcattcatctgttggatgaaattgtgcaggaaccggccatctatctgatggccagaaaaattgcgtgagaaggatttctcattaataaggactgttgatggctatgtcagacgaggcgatgtttgccccgccacaaggaataacaattgaagcggtaaacggaatgctcgcggagcggttagcacagaaacacggcaaggcgtctttattacgcgccttcatcccgctgccgccgccgttcagcccggtacaacttattgaactgcatgttctcaaaagcaacttctattaccgctaccatgatgatggcagcgatgtgacggcaacaacagagtatcagggcgagatggtcgattattcgcgtcacgccgtccttctcggcagtagtggaatggcggagctacgctttattcgcacccacggcagtcgttttacttcccaggattgcacactgtttaactggctggcgcggataatcaccccggttctgcaatcatggctcaatgatgaagaacagcaggtggcgctgcgtttgctggagaaagatcgcgatcatcatcgggtactggttgatattactaatgcagtgctgtcacatcttgatctcgacgatctgatcgctgacgtcgctcgtgagatccatcattttttcggtctggcttcagtcagtatggtactgggcgatcatcgaaagaacgagaagttcagcctgtggtgcagcgatctttctgcctcacattgtgcgtgtctgccacgctgtatgcctggcgaaagtgtattgctgacacaaacgctacaaacccgacaaccgaccttgacgcaccgtgcagatgatctgtttctctggcaacgcgacccgttattactcttacttgcatctaacggctgcgaatctgcgctccttataccgcttacctttggcaaccatacaccgggtgcattgttgctggcgcatacctcttccactctctttagtgaggaaaactgccagctactacaacacatagccgatcgcatcgctattgccgttggcaatgccgatgcctggcgtagcatgaccgatttgcaggaaagtttgcagcaagaaaaccaccagcttagcgagcagctcctttcgaatctgggcatcggtgacattatctatcaaagccaggcaatggaagacctgctccagcaggtagatattgtggcgaagagcgacagtacggtgttgatttgtggtgaaaccggaactggcaaagaggtgatcgccagagcgatccatcaacttagcccgcgacgcgacaagccgctggtcaaaatcaactgcgctgccatccccgccagtcttctggaaagtgagttattcggtcatgacaaaggggcgtttactggtgcgattaatacccatcgtggtcgttttgaaattgccgatggcggcacgttgtttctcgatgaaattggcgatctgccgttagaacttcagcctaaactgctgcgcgtattgcaggagcgggagattgagcgtctcggcgggagtagaacgatcccggtgaatgtcagagtcattgccgccaccaaccgtgatttgtggcaaatggttgaagatcgccagtttcgcagcgatctcttttatcgcctgaatgtcttcccactggaattgccgccgctacgcgaccgtccggaagatatccctcttttagcaaaacatttcacgcaaaaaatggcgcgccatatgaatcgcgcaattgacgccatcccgaccgaggcactacgccagttgatgtcgtgggattggccgggcaacgtgcgcgagctggaaaacgtgattgagcgggcggtactgttgactcgtggtaacagtctgaatttacatctaaatgtccgacaaagccgtttactgccgacgctaaatgaagattcagcgcttcgcagttcaatggcgcagttactgcacccgacgacgccagagaatgacgaagaagaacgtcagcgcattgttcaggtattgcgagaaaccaatggcattgttgccgggccccgtggcgcagcgacgcgattagggatgaagcgcaccacgctgctgtcacgaatgcagcggctggggatctcggttcgcgaggtgttgtaatctgcttttgcaggagtatgcatgagaaacaaactctctttcgacttgcagttgagcgccagaaaagcggcaatcgctgaacggattgccgcccataaaattgcccgcagtaaagtgtcggtctttttaatggcgatgtccgctggcgtgtttatggcgatcggatttactttttacctttccgttatcgccgatgccccgtcttcacaggcattaacccatctggtgggcggcctttgctttacactcggctttattttgctggcggtttgcggcaccagcctgttcacctcgtcggtaatgacggtgatggcaaaaagtcggggcgttattagttggcgaacttggctgattaacgcacttctggtggcctgcggtaatctggcaggtattgcctgtttcagtttgttaatctggttttccgggctggtgatgagtgaaaacgcgatgtggggagtcgcggttttacactgcgccgagggcaaaatgcatcatacatttactgaatctgtcagcctcggcattatgtgcaatctgatggtttgcctggcgctgtggatgagttattgcgggcgttcgttatgcgacaaaatcgtcgccatgattttgcccatcaccctgtttgtcgccagtggctttgagcactgtatcgccaatttgtttgtgattccgttcgccattgccattcgccatttcgcccctccccccttctggcagctggcgcacagtagcgcagacaattttccggcactgacggtcagccattttattaccgccaatctgctcccggtgatgctgggtaatattatcggcggtgcggtgctggtgagtatgtgttatcgggctatttatttacgtcaggaaccctgaaaaatcagcccggcgaaacagttcgtcgggctgaagattattcttgcgcgatttgcccatcgggccaggcatgaatcacggctttgatcagcgtcgccaacggaatggcgaagaatacgccccagaatccccacaaaccaccgaagatcaccaccgataaaataatcaccagcggatgcaggttaaccgcttcggagaacaacaccggcactaacaggttgccgtccagcgcctgaataatcagatacaccgcgaagcagctccagaattcagtacctgcgccaaactggaatagcgccacgccaaccaccggaatggtcaccacaaatgcgccaatgtacggaataagaaccgagaagccgaccagcactgccagcagcagcgaatagttcagcccgaagagcaagaaccccagccaggtggcgatccccaccacgatcatctccagcactttgccgcggatatagttggtgatttgttgattcatctccttccacacctgtcctgccagcccacggttacgcggcagcacccggcgaacggcgttcagcatctgctctttgtctttcagcaggaagaagaccatcaatggcaccagcaccagatagacggctatggtcagcaaaccgaccagcgaggcgagggaaattttcaccaccgaatcgcccatggtcagcatccgactgcgcatattttcggccattgcatcaataatgcccgcgtccattaacgccggatagcggcgcggcaacgtggcggcaaagtcagaaagcttattgagcatccccggcatatcgcggattaagtagatgccctgttgccaggcgataggcagtaccacgaacgccatcagtagcaatataccgacgaaaaccaccaatacaatcgacgtcgcccagcggcgggagcagccaatagattgcagacgcacggttggccattccagcaaataggccagcacaatagccaccagcaacggagcaagcaggccactaaagaaaaagataatgccaaatccggcaactaaaataaccagcaaggcaatcgcttccgggtcgctaaaacggcggcgataccattgcatcaacatttcgagcataaagaccttccctgaacctcaagagcgggattgcgatccgcaattgtatcgaaatgtcacaaaaaagacttcgctttttatgacggattcaggaaactgaaaagtcatttgagtgggctaatcttcgccgttacactcaaaggcggcgcggtgggaacgatatttcacagtatcggtcaaatgactatctccagaaatacaggatagaggttatgttcaggcagttgaaaaaaaacctggttgcaaccctcattgctgctatgaccattggtcaggtagccccggcgtttgccgacagcgcagacaccttgccggatatgggaacctccgcaggaagcacgctttccattggtcaggaaatgcagatgggcgactattatgtccgccagctacgcggcagcgcgccgttaattaatgacccgctgttaacgcaatatattaattcgctggggatgcgtctggtttcgcatgccaattcggttaagacaccgtttcatttttttctgatcaacaacgacgaaattaacgcctttgctttctttggcggcaacgtggtgctgcactctgccctgttccgttattccgataacgaaagtcaactggcttcagttatggcgcacgaaatctcccacgtcacccaacgtcacctggcgcgagcgatggaagatcagcagcgcagcgcgccgctgacctgggtcggcgcgttaggttctattttactggcgatggccagtccgcaggcggggatggcggcgctgaccggtacactggcgggaacgcgtcaggggatgatcagtttcacccagcaaaatgaacaggaagcggaccgcattggtattcaggtgctgcaacgctcgggattcgatccgcaggcgatgccaaccttcctcgaaaaattactcgatcaggcgcgttactcctcgcgcccgccggaaattttattgactcacccgttgccggaaagtcgtctggcagatgcccgcaaccgtgctaatcagatgcgcccgatggtggtgcagtcgtcggaagatttctatctggcgaaagcgcgcacactggggatgtataattccggacgtaaccagctcaccagtgatttgctggatgaatgggcgaaaggaaacgttcgtcagcaacgagcagcacaatatggtcgtgctttacaggcgatggaagccaataaatacgacgaggcgcgtaaaacgctgcaaccgttactggcggcagaacctggcaacgcatggtatctcgatctggctactgatatcgatcttgggcaaaacaaagccaatgaggcgatcaatcgtctgaaaaatgcccgcgatttacgcaccaatccggtgttgcagctcaacctggcgaacgcttatttgcaaggcggtcaaccacaagaagcggccaatattctgaatcgctacacctttaataataaagatgacagcaacggctgggatttgctggcacaggcggaagccgcgctaaataaccgcgatcaggagctggctgcgcgagcagaaggttatgcgctcgccggacgactcgatcaggccatttcgctgttgagtagcgccagttcgcaggtgaaattaggcagcctgcaacaagcgcgttacgatgcgcgcatcgaccagttgcgccagctgcaggaacgctttaagccttataccaagatgtaattcgcattaaaggaagaacaatgaccaaacaggtaaaaatctaccataacccacgctgttcaaagagccgggaaacgctgaacctgctgaaagaaaacggcgtggagccagaagtggtgctctaccttgagacacccgccgatgcggcaacgctgcgcgatttgctgaaaatactggggatgaatagcgcccgtgaattgatgcgccagaaagaggatctttataaagaactgaacctggctgacagttcgcttagcgaagaggcgctgattcaggcaatggtggataatccgaagctgatggagcgcccgattgtggtcgcgaatggcaaagcgcggattggtcgtccaccggagcaggtactggaaatcgtgggttaagatgtgctccatcgctagttgaagcacattgccggatgcgacgcttgccacgtcttatccggcctacgaatactatggattaacttcgcgtagttcggataaggcgttcgcgccgcatccgacaataaacaccttatctacaacttcagaatttctttcacaaacggaatggtcagcttacgttgcgcggtaatcgacgcacgatccaactgatccaacgtcataaatagcgtgcgcatttctctgtcgagccgcttcagcaagaaacgccccacatcttccggcagttcaaaaccacgcaaacgcgcgcgtaactgtagcgcctgcaacttatcttcatcagaaagtggctgcaatttgtagatctgcccccagtcgagtcgcgacgcgagatccggtaatcccagattcaactgccgcggtggacgatcgccggtgatcaacaaccgtgttttgcccgattccagaattcgattgtagagatcgaaaatcgccatctcccacaactcatcgcctgcaatacactcaatgttgtcgatacagaccagcgacaaatgctccataccgtcgagcacttccggaacaaaccaggtgcgtttatccagcgggacatagcccaccgcatcgccacgctgcgacaattccgcgcaagccgcgtgcagcagatggctgcgccccgcgccttcgcgtgcccagagatagatgtaaccgctatgttcctgacgcagcacgttttgcagcgcggccagtaaagaggagttatcccccggccagaaacttgcaaaggtttcgtcgtcaggaagataaagtggcaaagagagctgtgccggtgtgttcagagatacctcaaccaggatttcacaaaatcgcgagaagtttaccacagaatcccatgatgtttgaaccgggcagcaacactgcccggtcggtacattatttgtctgttatatccgcgtcttctgcgtccagcaccacttcttcagggcgcagcacactgatcagtttgaagatcaaacttaagccgataccgacgatggtcgccagcgccataccttttaactccgccgcgccgatgtttaccttcgcgccactgacgccgatgatcaaaatcacggaagtcaggatcaggttctgtgctttgttgtaatccactttcgattcgatcaaaacacgaataccggaagcaccgatgacaccataaagcagcagcgaaacgccgcccatcaccggcaatgggatcatctggatagcggcagccagtttaccgacgcaggaaagcaggatagcgaaaatcgccgccccgccgataacccaggtactgtaaacacgggtgatcgccatcacgccaatgttttctccgtaagtagtatttggcgtagagccaaagaagccggaaatcacggtcgacaagccattagcaaacatcgaacggtgcagacctggatcgcgcagcagatcttttttgacgatattagccgttactaccaggtgccctacgtgttcggcaataaccactaacgccgctggcagaatagtcagaatggcaaaccactcgaagcgcggcgtatagagggttggcagcgcaaaccagtgagcattaataatcggcgtggtatcgacaattcccattgcgaaagagagcgcgtaccccaccagcacgccaattaaaatcgggataattgccaggaaaccacgaaacagcacggaacctaaaaccgtgaccgccagggtggtaatagagatgatgatggttttggagtctggcgtttgcccttcagccgggagtaaacccgccataccggcagctacgcccgccagctccagaccgatgacggcaacgattgcgcccattgccgcaggtggaaacagcacgtccagccagccggtccccgctttcttcacgataaaagaaaccaggcagaacagcacgccgcacataataaagccgcccagcgcgacttcataccctaacggcaacagtaacaataccggtgaaataaaggcaaagctggaaccaagataagccggaattttccctttacagatgaagagatacagcagcgttccaataccgttaaataacagtacagtcgccgggttaatatgaaataagacgggcaccaggacggttgcaccaaacatggcgaacaaatgttgcaaactaagcgggattgtctgtaaaagtggcggtctttcactcaccccgatagcacggcgcgtcatagtattatcctctgtattatgtgttataggcgctttactcaaaaaaaagccgactcttaaagtcggctttaattatttttattctttatttcgtaccaaagattttgtcaccggcatcgccgaggcccggaataatgtatccgtgctcgttcagtccctgatcaatcgatgcggtatacagttcgacgtccgggtgcgctttttccagcgcagcgataccttctggcgcagctaccagcaccagaactttgatgctgctgcagcccgcttttttcagcaggtcgatggtcgcgataacggaaccaccggttgccagcattgggtcaacgatcagcgccatacgctcatcgatgttagaaaccagtttctggaagtacggtaccggctccagcgtttcttcattacggtacataccgacaacgctgatgcgcgcgctcggaacgttttccagcacaccgtccatcataccaagacccgcacgcagaattggcacaacggtaattttcttacctttgatctggtcgatttctaccgggccgttccagccttcgatagttactttttccgtttcgaggtcggcggtcgcttcgtaagtcagcaggctacccacttcggaagcgagttcgcgaaagcgcttggtgctgatatcttgctcacgcatcagtcccagcttgtgtttgacgagtgggtgtttgacttccacgatcttcatactctttctcctttgaggggcagccacaaaaaaaatcgacggattatacctcctttcttcaaggcggcaatattcttttcgttgactttagtcaaaatgataacggtttgagataaagttattttatattcagatggttatgaaagaagattattccatccgaaaactaacctttaccctggcacaagtcttctttcgccgcgcgcctggggaaaagacgtgcaaaaaggttgtgtaaagcagtctcgcaaacgtttgctttccctgttagaattgcgccgaattttatttttctaccgcaagtaacgcgtggggacccaagcagtgaccgataaaacctctcttagctacaaagatgccggtgttgatattgacgcgggtaatgctctggttggaagaatcaaaggcgtagtgaagaaaacgcgtcgtccggaagtgatgggcggtctgggcggcttcggtgcgctgtgtgcattgccgcaaaaatatcgtgaacccgtgctggtttctggcactgacggcgtaggtaccaagctgcgtctggcaatggacttaaaacgtcacgacaccattggtattgatctggtcgccatgtgcgttaatgacctggtggtgcaaggtgcagagccgctgtttttcctcgactattacgcaaccggaaaactggatgttgataccgcttcagcggtgatcagcggcattgcggaaggttgtctgcaatcaggctgttcactggtgggtggcgaaacggcagaaatgccggggatgtatcacggtgaggattacgatgtcgcgggtttctgcgttggcgtggtagaaaaatcagaaatcatcgacggctctaaagtcagcgacggcgatgtgctgattgcactcggttccagcggtccacactcgaacggctattcgctggtgcgcaaaattcttgaagtcagcggttgtgatccgcaaaccaccgaacttgatggtaagccattagccgatcatctgctggcaccgacccgcatttacgtgaagtcagtgctggagttgattgaaaaggtcgatgtgcatgccattgcgcacctgaccggcggcggcttctgggaaaacattccgcgcgtattgccagataatactcaggcagtgattgatgaatcttcctggcagtggccggaagtgttcaactggctgcaaacggcaggtaacgttgagcaccatgaaatgtatcgcaccttcaactgcggcgtcgggatgattattgccctgcctgctccggaagtggacaaagccctcgccctgctcaatgccaacggtgaaaacgcgtggaaaatcggtatcatcaaagcctctgattccgaacaacgcgtggttatcgaataatgaatattgtggtgcttatttccggcaacggaagtaatttacaggcaattattgacgcctgtaaaaccaacaaaattaaaggcaccgtacgggcagttttcagcaataaggccgacgcgttcggccttgaacgcgcccgccaggcgggtattgcaacgcatacgctcatcgccagcgcgtttgacagtcgtgaagcctatgaccgggagttgattcatgaaatcgacatgtacgcacccgatgtggtcgtgctggctggttttatgcgcattctcagcccggcgtttgtctcccactatgccgggcgtttgctgaacattcacccttctctgctgccgaaatatcccggattacacacccatcgtcaggcgctggaaaatggcgatgaagagcacggtacatcggtgcatttcgtcaccgatgaactggacggtggcccggttattttacaggcgaaagtcccggtatttgctggtgattcggaagatgacatcaccgcccgcgtgcaaacccaggaacacgccatttatccactggtgattagctggtttgccgatggtcgtctgaaaatgcacgaaaacgccgcgtggctggatggtcaacgtctgccgccgcagggctacgctgccgacgagtaatacccccgtaattaaagcgccagctctgccgctggcgtttttcaattcacctgtaaatcgcaagctccagcagtttttttcccccttttctggcatagttggacatctgccaatattgctcgccataatatccaggcagtgtcccgtgaataaaacggagtaaaagtggtaatgggtcaggaaaagctatacatcgaaaaagagctcagttggttatcgttcaatgaacgcgtgcttcaggaagcggcggacaaatctaacccgctgattgaaaggatgcgtttcctggggatctattccaataaccttgatgagttctataaagtccgcttcgctgaactgaagcgacgcatcattattagcgaagaacaaggctccaactctcattcccgccatttactgggcaaaattcagtcccgggtgctgaaagccgatcaggaattcgacggcctctacaacgagctattgctggagatggcgcgcaaccagatcttcctgattaatgaacgccagctctccgtcaatcaacaaaactggctgcgtcattattttaagcagtatctgcgtcagcacattacgccgattttaatcaatcctgacactgacttagtgcagttcctgaaagatgattacacctatctggcggtggaaattatccgtggcgataccatccgttacgcgctgctggagatcccatcagataaagtgccgcgctttgtgaatttaccgccagaagcgccgcgtcgacgcaagccgatgattcttctggataacattctgcgttactgccttgatgatattttcaaaggcttctttgattatgacgcgctgaatgcctattcaatgaagatgacccgcgatgccgaatacgatttagtgcatgagatggaagccagcctgatggagttgatgtcttccagtctcaagcagcgtttaactgctgagccggtgcgttttgtttatcagcgcgatatgcccaatgcgctggttgaagtgttacgcgaaaaactgactatttcccgctacgactccatcgtccccggcggtcgttatcataattttaaagactttattaatttccccaatgtcggcaaagccaatctggtgaacaaaccactgccgcgtttacgccatatttggtttgataaagcccagttccgcaatggttttgatgccattcgcgaacgcgatgtgttgctctattatccttatcacacctttgagcatgtgctggaactgctgcgtcaggcttcgttcgacccgagcgtactggcgattaaaattaacatttaccgcgtggcgaaagattcacgcatcatcgactcgatgatccacgccgcacataacggtaagaaagtcaccgtggtggttgagttacaggcgcgtttcgacgaagaagccaacattcactgggcgaagcgcctgaccgaagcaggcgtgcacgttatcttctctgcgccggggctgaaaattcacgccaaactgttcctgatttcacgtaaagaaaacggtgaagtggtgcgttatgcacacatcgggaccgggaactttaacgaaaaaaccgcgcgtctttatactgactattcgttgctgaccgccgatgcgcgcatcaccaacgaagtacggcgggtatttaactttattgaaaacccataccgtccggtgacatttgattatttaatggtatcgccgcaaaactcccgccgcctattgtatgaaatggtggaccgcgagatcgccaacgcgcagcaagggctgcccagtggtatcaccctgaagctaaataaccttgtcgataaaggcctggttgatcgtctgtatgcggcctccagctccggcgtaccggttaatctgctggttcgcggaatgtgttcgctgatccccaatctggaaggcattagcgacaacattcgtgccatcagtattgttgaccgttaccttgaacatgaccgggtttatatttttgaaaatggcggcgataaaaaggtctacctttcttccgccgactggatgacgcgcaatattgattatcgtattgaagtggcgacgccgctgctcgatccgcgcctgaagcagcgggtactggacatcatcgacatattgttcagcgatacggtcaaagcacgttatatcgataaagaactcagtaatcgctacgttccccgcggcaatcgccgcaaagtacgggcgcagttggcgatttatgactacatcaaatcactcgaacaacctgaataaccctatgccaatacacgataaatcccctcgtccgcaggagtttgctgcggtcgatcttggttcaaacagttttcacatggtcatagcccgtgtggtagatggtgccatgcagattattggccgcctgaaacagcgggtgcatctggcggacggcctggggccagataatatgttgagtgaagaggcaatgacgcgcggtttaaactgtctgtcgctgtttgccgaacggctacaagggttttctcctgccagcgtctgtatagttggtacccatacgctgcgtcaggcgctgaacgccactgactttctgaaacgcgcggaaaaggtcattccctacccgattgaaattatttccggtaatgaagaagcccgtctgatttttatgggcgtggaacatacccaaccggaaaaaggtcgcaaactggttattgatattggcggcggatctacggaactggtgattggtgaaaatttcgaacctattctcgttgaaagccgccggatgggttgtgtcagctttgcccagctttattttcctggcggggtcatcaataaagagaattttcagcgcgctcgcatggcggcagcacaaaaactggaaactttaacctggcaattccgtattcagggctggaacgttgcaatgggcgcttccggtaccataaaagccgcccatgaagtgttaatggaaatgggcgagaaagacgggataattaccccggaacgtctggaaaaactggtaaaagaagttttacgtcaccgtaatttcgcatcgctgagtttaccgggtctttccgaagagcggaaaacagtcttcgttccgggactggcgattttatgcggtgtgtttgatgctttagccatccgtgaactgcgcctttctgacggggcgttacgcgaaggcgtactgtatgaaatggaaggacgtttccgtcatcaggatgtgcgtagtcgcaccgccagcagcctcgccaaccagtatcacatcgacagcgaacaggcccgacgggtgctggataccactatgcaaatgtacgaacagtggcgggaacagcaaccgaagctggcgcatccgcaactggaggcgctactgcgatgggccgccatgctgcatgaggtcgggttgaatatcaaccacagcggtttgcatcgccactccgcttatattctgcaaaacagtgacttgccgggttttaatcaggaacagcagctgatgatggcgacactggtgcgctatcaccgtaaagcgattaagctcgacgatctaccgcgctttaccttgtttaagaagaaacagttcctgccactgatacagctattgcgccttggcgtattactcaacaatcaacgtcaggcaaccaccacaccgccaacattgacgctgattactgatgacagtcactggacactgcgtttcccgcatgactggtttagtcagaatgcgctggtactgcttgatctggaaaaggagcaagaatactgggaaggcgtggctggctggcggttgaaaattgaagaagaaagtacaccagaaatcgccgcttaatactttgcgggccgacgagaaatgtcggcccgcattattcaggcactttcgcgaatgggttcgatttcattcagcgtatcaattaacggctgcggcttaccaataagataaccctgcatataatcgatccccaaagagagcaccgcctcgcggatctcttcgttttcaacgtactctgccactaccagcattttcttcattcgcgccaggtggcaaatcgatgccactatctgataatccagactatttgacacaatattgcggataaaactgccgtcaattttaagcagatcggcattcacatttttaagccgcgcatagctggcgtagccggtgccgaaatcatcaatcgcaatctggcagcctaattcctgaagatgctgcaaggtgatttgcgcctgcttaacattggtcagagcattactttcggtgacttcaaaaataagttgccacgcttcaatctgatatttagccagcaactgactgacttcaacaggaaaacgagcctgacataccgaggttggagacagattaatagcaaaacggtgagcgggcatcttcgctctgttttcagccataaattgcagcgtatgctcaatgacccacatgtcgatactcgacgataaaccaaattcgtgcgcgaccggcaagaagctatcggggctgatcagttcatcattctcacctttcatgcgcagaagaatttcatggtaaacatcaccacgcataccggtaatcggctgggccatcaggaaaaaatggttgtgttccagcgcctgctgtagtcgattcatcatcgcgactttatctttcaattcgcgttgcaaatacattgccccgcgacgctgcatattttccggggcgttggtcacgatggaaagttcggcgaccgtatttagctctcccagcagcaggtagatatgattcactggcgagcgcacatagcagtaactgacgccaatctgcggttgcatcggcatgccatcccaaaagaaacgaaattgcttgagatggctatccagtgcggtaatgcgctcctggtgcgattctgtattcagtcgcagcgcgagatcgttacccgaaagctgataaacatcttcacccggttccagcaagggtgacagccagtgagaaagtttttgcttgtattgaatccgcagcatgatgccatagttcttaaccagcatttccatgccagggatgcgtaaataacaaagcgcagaccagggggcatcacgcaacgcgcgattcagggcgcgaacatttggcagatgaaccaccgggtccacatacgcaagccgctgaatgcgtctgactaccgctctctgacgggttgccagtacagccatataattgacaataaaagagaataccagataactggaggaggttatggtcagctgcgtggtatagccaggataaatgggaatgtaattttgatagctgtggatgctgatcatcaacacgaccgcccagagcagcgaaatcagcttataaccatagcgcatcgctccccacatcatcaggggcagcaataatgacaaggtataattggtgctaaaaattgtgcttttttcatttaacggcatgcataacagcaacaataaagcacctaatgccagtagccagagcgcgaactcttttttggtgactttggcatcaacctgctgttttaattgcgaataatagctacgtaaataaaatggatttcgcactacccgaatgatgaagtagcacagcgggacaccgatcagattacccaccagtaaggcctgataattgattaaagtcccgaggttaaaaggcatgacaccgaccagattttctctgctcgccagtaatcctacaaatgcagcaaactggaaaagtatcagaaacagcgttgcaggaaacacaatctgccagaatatacgctgggaaattaaacgggtatcaccatgtgaaacgttgttacgccggggagtaaagaccctgtaaccgccccaacagagaatgataatgataataaaattagccgttaatgatagcgtttcgtaaaaacccagctctgcatatttgcggacaaaaatccctaaggcgatccctggcaatgccgcccagctgaaaaacatcatcatgctgatcatcagtgccagaggcagataaaagagaaaaacctcaccggaagaaatatgcgcgaaagtattaatgtgggcgaaaatgggcaagattaaagaaggcaggaacagcggaagcccccaccatttatcacgtatttttatataagttgcattcagtttcatagatgctcagcagaatcccccacatcctgaaggaggtgtattcagacaggcatcccacctgacttcgaatgatgattattcatcactatagagagcattgattctaagtgtcatatgaaagtaccaattgatatatatcaaacaaaataaccctgattaatgaattattacgtttatcatgttaattcatcattattacatcatcattgtaaataattaaattaacttccataacattaaaatatgtatccactgacgcttttttacataacgaagaattgaccattttgtcctgttgtgccttaatgtaagtaccgtccacagcgtgggacatacttcaaggaaccttttgtgagtcaggcaaccagtatgcgaaaacgacaccgatttaacagtcgcatgacccgtatcgtactgctcatcagctttatcttcttctttggccgttttatctactcgtccgtcggtgcctggcagcaccatcagagcaaaaaagaagctcagcaatccacactctccgtcgaatcaccggtacaacgttagcggttaccttctccactttcacagaacataacggcacttcgctgtcggatgcttttgctgtttgggattatcaaagcggcagatattctttcatcttaaattttacgtctttatcctgactgatgtttatcctgtttggctgcgaaataaatataaaattaatatatatgttgtaatgatatatttttataaattattccctgcgtgaattttaataaatttaatctatccctttatacgcaatacatttactttcctcttttgatgatcttaaatgtcttatttttcgtaatgtgtataacaaggaatagtgatgaaatttaaaaaatgtcttctgcctgtggcaatgttagcgtcattcactctggcaggatgccagtcaaatgctgacgatcatgctgccgatgtttatcaaaccgatcaactgaataccaaacaagaaactaaaaccgttaatattatttccattcttcccgcaaaagttgccgtagacaactcccaaaataaacggaacgcacaagccttcggcgcgcttattggcgcagtcgctggcggtgttatcggccacaacgtcgggtctggcagcaattccggaacgacggcaggtgcagttggcggcggagctgtaggcgcggcagcgggttctatggtgaatgataaaaccttagtggaaggtgtttctttaacctataaggaaggcaccaaagtgtatacctctacccaggtgggtaaagagtgccagtttacgacaggtttagccgttgttattaccacgacgtataacgaaacgcgtattcagccaaataccaaatgtcctgaaaagagctaataatcaggaggagtcatgaagaaagtttttctttgcgccatcttagcctccttaagctatccggctatcgcctcatcattgcaggatcaactctctgctgtcgcagaagcggaacagcaaggtaaaaatgaagagcaaaggcagcatgacgaatgggtcgcggagcgcaacagggaaatccagcaagagaagcaacgtcgcgcaaatgcccaggccgccgctaacaaaagagcggcaacggcagcggcaaataagaaagctcgtcaggataaactggacgccgaagcctctgcggacaaaaaacgcgatcaaagttatgaagatgagctacgcagcttagagattcagaaacaaaaactggcgctggcgaaagaagaagcccgcgttaagcgagaaaacgaatttatcgatcaggaactgaagcacaaagctgcgcaaaccgatgtggtgcaatctgaagctgacgccaacagaaatatgactgaaggcggtcgcgatctgatgaaaagcgtgggcaaagcagaagagaacaaatcggacagctggtttaattaatcgatgttagtaacttcaatcctataattcttgaagataaaaaaccctctgtagtaacagagggttttgttcattcatagtgcagggtcaaatcattcccactcaatggtagctggcggcttgccgctgatgtcatacaccacgcgggaaataccgttcacttcattgataatgcggttggaaacgcgaccgaggaaatcgtacggcagatgcgcccagtgtgcggtcataaagtcgatggtttcgacagcacgcagagagacaacccagtcatacttacgaccatcgcccattacgccaacggaacgtaccggcaggaacacagtgaacgcctggctgactttgtcgtacaggtccgctttacgcagttcttcaatgaagatggcgtcagcacggcgcagcaggtcacagtactctttcttcacttcacccagaacacgaacgccaaggcctggtcccgggaacgggtgacggtacagcatgtcgtacggcaggcccagctccagaccaatcttacgcacttcgtctttgaacagctctttcagcggttcaaccaggcccatcttcatctctttcggcaggccgcccacgttgtggtgagatttgatgacgtgtgctttaccggttgcagacgccgcagattcgataacgtcagggtagatggtgccctgcgccagccacttcacgtcttccagtttcagcgcttcttcatcgaatacttcaacgaaaacgcgaccgatgattttacgttttgcttccggatcgttttcgccagccagcgctgacaggaagcgatcttctgccggtacgtgaacaatgttaagaccaaagtgatcgccaaacatatccagaacctgctctgcttcgttgaggcgcagcaggccgttgtcgacgaatacgcaagtcaggtttttaccgatagcgcggtgcagcagcattgcggttacggaggaatccacaccaccagagaggccgaggatgactttatcgtcgcctacctgctcgcggatgcgagctacagcatcgtcgataattttcgctggcgtccacagggcttcacactggcagatatcacgcacaaaacgctccagcatgcgcataccctggcgggtatgagtcacttccgggtggaactgtacgccatagaagcgtttttcttcgttagccataatggcaaacgggcagctttcggtgctggctacggtgatgaagtcggacggaatagcggtaactttatcgccgtggctcatccagacatcgagcagcggtttaccgtctgcggtcagcgcatcttcgataccgcgaaccagtgcgctgtcgtttacgacttcaacctgcgcgtagccaaattcacgttcgttagaggcttcaacgtgaccgcccaactgcattgccatggtctgcatgccatagcaaacgccgaataccggtacgcctgcttcaaagacatactgcggcgcacgcggactgttttcttcagtagtactttccgggccgccggaaagaataatgccgcttggattgaagtcacgaatttgtgcttctgtcacatcccacgcccacagttcgcagtaaacacccagctcacgcacgcggcgcgcaaccagttgagtgtactgagaaccgaagtccagaatgaggatgcgatgcttatgaatgttttccgtcattgacgcttattccgaggcaagtgaaacagataatataaatcgcccgacatgaagtcgggcgaagagaatcaggagcccagacggtagttcggggactctttagtaatggtcacgtcgtgaacgtggctttcctgaatgcccgcaccgctgatacgtacaaactccgctttagtacgcagttcgtcgatagtaccacagccggtcagacccatacaggagcgcaggccgcccatctgctggtgaatgatctctttcaggcgacctttataggctacgcgaccttcgataccttccggcaccagtttgtcggcagcgttatcgctctggaaataacggtcagaggaacctttggacatcgcgcccagggaacccataccacggtaagatttgtaagaacggccctggtagagttcgatttcacccggagattcttcagtacccgccagcatggaacctaccatcaccgcgcttgcgccagcggcgatagctttggcgatgtcgccggagaagcgaataccgccatcagcgataaccggaataccggtgccttccagggcttctactgcgtcagcaacagcggtaatctgcggaacaccgacgccagtcacgatacgagttgtacagatagagccagggccaatgccgactttaaccgcactgcaaccagcttctgccagagcgcgtgcacctgcagctgttgccacgttgccgccgataatttgcagatccggatatttagcacgggtttcacggatacgttgcagtacaccttctgagtgaccgtgggaggagtcgatcagcagaacgtcaacgcctgcggcaaccagcgcgtcaacacgctcttcgttacccgcacctgcgccaaccgctgcaccaacacgcagacggccttgctcgtctttacaggcgttcggtttacgttccgctttctggaagtctttcacggtgatcatgccgatcaggtggaattcgtcatcaaccaccagcgctttttcaacgcgtttttcgtgcatttttgccagcaccacttcacgggcttcaccttcacgcacggtgaccagacgctctttcggcgtcatgtaaacgctaaccggctggttcaggtcggtaacaaaacgcacgtcacgaccggtgataatacccaccagttcgttttcttcggtaacgaccggatagcccgcaaaaccgttacgctcggtcagttctttcacttcgcgcagcgtcgtggttggcagaacagtctgcggatcagtcaccacaccagattcgtgttttttcacacggcgaacttcttctgcctggcgttcaatggacatgtttttgtggataaagccgataccgccttcctgagccagagcaatagccaggcgcgcttccgttacggtatccattgctgcggaaagcatagggatattcagacgaatagttttcgtcagctgggtgctgaggtcagcagtattcggcagaacggtagagtgagcaggaacgaggagaacgtcgtcaaacgtcagagcttctttagcgatacgtagcatgggcaatatctcgaccagagtggttaataaatattgccgcggcattatacagagcgtaaccgattgcatctacccctttttgcaaaaaatgcttgctatccccgaagggcgggttactatcgactgaataacctgctgatttagaatttgatctcgctcacatgttaccttctcaatcccctgcaatttttaccgttagtcgcctgaatcaaacggttcgtctgctgcttgagcatgagatgggacaggtttggatcagcggcgaaatttctaatttcacgcaaccagcttccggtcactggtactttacactcaaagacgacaccgcccaggtacgctgcgcgatgttccgcaacagcaaccgccgggtgaccttccgcccacagcatgggcaacaagttttagttcgcgccaatattacgctctacgagccgcgcggcgactaccagataatcgttgagagtatgcagccggccggtgaagggctgctgcaacagaagtacgaacagctcaaagcgaagttgcaggctgaaggtttgttcgatcagcaatacaaaaaaccacttccctcccctgcgcattgcgttggtgtgatcacctcaaaaaccggtgctgcgctacatgatattttgcatgtgttaaaacgtcgcgatccttctctgccggtgatcatctaccctgccgccgttcagggcgatgacgcgccggggcaaattgttcgcgccattgaactggcgaatcagcgcaatgagtgcgacgtattgatcgtcgggcgcggcggcggttcgctggaagatttatggagttttaacgacgaacgcgtagcgcgggcgatttttaccagccgcattccggttgtcagcgccgtcgggcatgagacggatgtgaccattgccgattttgttgccgatctgcgtgcgccaacgccgtctgccgccgctgaagtagtgagccgtaatcagcaagagttactgcgccaggtgcaatcgacccgtcaacggctggagatggcgatggattattatctcgccaaccgcacacgtcgctttacgcaaattcatcaccgattacagcaacagcatccgcagctccggctggcacgccagcaaaccatgcttgagcgcctgcaaaagcgaatgagctttgcgctggaaaatcaacttaagcgtaccgggcaacagcagcagcggttaacacagcggctgaatcagcaaaatccacagccgaagattcatcgcgcgcaaacgcgcattcagcaactggaatatcgtttagcagaaaccctgcgcgcacagcttagcgccacgcgtgaacgtttcggtaatgcagtaacgcacctcgaagccgtaagcccactgtcaacgctggcgcgtggatacagcgttactactgctactgacggcaatgtactgaaaaaagtgaagcaagttaaagcgggtgaaatgctaaccacacgtctggaagacggctggatagaaagtgaagtaaaaaacatccagccagtaaaaaaatcgcgtaaaaaggtgcattaagccagcacgaattcaacgcgttttttcgatatcaagccatgcccgtgctgacagaagtaatctactgcaccacaggcttttaacacctgcaacggttgatggcagtctggacaaagagctttcatttcaataaattccccgcaggatcggcaacgcgcatggccgttatcctgatcaagcacatgctgacattgtggacaatgcagttccatatgaattcctccggtagccattccctctacattcatagagggaatggcagataaaatacttacggataattatttatttttcttgatgtgcttcatcagacgcttacgtttacgcatctgggttggcgtcagggtgttacgcttattcgcatacgggttttccccttctttgaactgaatacgaatcggcgatcccattacgtccagcgatttgcggaagtagttcatcaagtagcgcttgtaggaatcaggcaggtctttcacctgattaccgtgaatcaccacaatcggcgggttataaccaccggcgtgggcatatttcagcttcacacgacgaccgcgtaccagcggcggttggtgatcttcaacagccatcgtcatgatgcgcgtcagcatagaggtccccacacgacgggtggagctgtcatacgcttcacgtactgattcaaacaagttaccaacaccactgccgtgcaaggcagagataaagtgcacacgagcaaaatcgataaagcccagacggaagtccagcgtttctttcacctgctctttcacttcctgactcaggccatcccacttattcaccacaatgacaagtgagcgcccactattgagaataaagcccagcagcgagagatcctgatcggaaataccttcgcgcgcatcaatcactaacatcaccacgttggcgtcttcaatggcctgcaacgttttgattacggagaatttctctacagcatcggtgattttgccgcgtttacgtacgccagcggtgtcaatgagcacatactcacgtccatcgcgttccattgggatgtagatgctgtcacgcgtcgtgccaggcatgtcgtaaacaacaacgcgctcttcaccaagaatacggttagtgagtgtagacttacctacgttcggacgacccacaatcgccagtttgatcggcagactttgcgggtcgaagtcgtcttcctcttcttcttcgccgttctcttccgcttcaaattgcgcccagtattcagcgtcttcgtcgacttcctcttgcggtgcgagatcttccatccacggcagcagcacatgctccagcagacttaatacgccacgaccgtgagacgcggcgatcgggtagatttcacctaaaccaagcgagtagaaatcaaccactgcctgatcgggatccagaccgtcagttttgtttgccaccaggaaggtcggtttttcacgggagcgcagatgtttggcaatcgcttcatctgccggcatcaggcccgcgcgcgcatccaccataaacagtacgacgtccgcttcttcaatcgccagcagcgactgttccgccatgcgggtttctacaccgtcttctgtgccatcaatcccgccggtatcaatacagataaactcacggccttcaatttccgcacgaccgtacttacggtcacgagtcagacccgggaaatccgcaaccagcgcatctcgggtgcgagttagacggttaaataacgtggattttcctacgttagggcgcccgacaagcgcgaccacaggtaccatgtttaaagcctcatttttataaatcatcagacaacgcacgctatattcgcgtcgttgttaaaaacaggaaaacggcccctgtccaggagccgttttcaaagtgaacgacagagacgattaacgtgtaatagagtacacggttccgtcttttgcctggatcagcagtttgccgtcagcggcaaccggttcagtctggaaaccggaactatcaactttttgctgggcaacgaaacgaccatcttcgacgttaatccagtgcagataaccttcactgtcaccgaccaccaggttgccattatacagcaccggagaagtcagcaggcgatgcagcagatcgctttgtgtccacagcgtaacgccgccatcaatggtcaacgccatcacccggtcattttgatcgaccagatagatgcgattgccgtcgacgatgaaatcattcaccgaacccagttcgcgtttccacataatctgaccactgcgcagatcaagcgccgtcaggttaccattataggccagcgcgaaaacaacgccgttaacaacgacgggagtcgtgtcaacatcgctcagacggtcaatttcggtagaaccggtcgcctgggaaatacgctgctgccaaatcatctggccctgttccatcagcactgcgctgacgcgaccattatcgccccccacgacggccgcaccaaaagccgttgtcggcgcagactcgccacgcaaagagagcgaaggcatatcgaggttaactgtccatttgacagcgccgtcagcttcgttcagcgcttgtaactgaccgttactggtgtggattaacaccagaccgtcgctgaccaccgggcgcgaaagtgcttcacccgcgactttagtttgccatgccacagtaccatcgctggtattcagcgcgtaaacctgcgccttttcgctgccaatgtagacatgcccaccagacacggtcacaccgccagaaagtaatgcaggctctttagagaaccagccatctttctcggccaggctgacagaccagatttctttgccatcatccgcattcagcgcttttactaaaccagcgcggtccgctgcatagacaacgttgtccgccagtgccggatgaagattggaatagaagttgccaatgccgctaccaacggaagtgctccacgccgtggtcggcgtaaactggttttcaacggttggcaatggggacatctttaccacatcttcttcgctgttaaacagcgaacagccgcttaaaagggtaacggaaagcagtcctggcagcagtaatttacgcaattgcatcgggtccctctcagatggacaaattattaattttcatctgcatcatttcgctcagtgccggagtaacatcgcttttcacgcctgcttcccatgcactacgcgcaccttgcttatcacctttgctcagcaatgcttcaccacgcaggtcggcaacaatggcagcccacccttcacctttgatggtatcaagggttttcagcgcggcatcagcctgcttgagctgtacctgaacgcgagcaagacgcagatttatcacggctttgagattttcatcgctcgtgtctgccagcccctgttgtaactgggcggcagctttctctagttcatttttgtcaacaaattgctgcgcaagttccaaagaagccagcgcaccataagtatttttattttcagcagcaaatttttccgccgccgggatgctatccggtttgccttcgctcactgcggtaaccgcattttgataggcaagagaagcggagcgtgcagaatcaacctgatggctgttccagtagcgccagccaatcagtgcgccaacgcccaaaatcaccccaacagccagtgctttgccattttcagcaaaaaagcgtttaaccgcttctacctggtcgttttcgttctcgtaaatttccacgctgtccttctccttccttaacccagtaacgtgcgcaaatgcgcggctacgctatcctgcgcaactgccgtttgctcaccagagcgcaaatccttcactactgctgtgccgttagccacttcagactcacccagcaccacagcaacgcgggcaccccatttatcagcacgggcaaactgtttcttaaagttgccgccgccgtggttggtcatcaatttcacgcccggtaattcatcacgcagacgctcagctaatgccatagccgcagattgtgtatcagcacctgaagccaccaggtatatatcgacaacaggatcggctttaaattccggattaacggcctgtactaacaatacaagacgttcgaggcccatagcaaaaccgacagccggtgttgcacgaccgcccagttgttccacaagaccgtcataacgaccgcctgcacacacggtgccctgggagccgagactgttagtcacccactcgaaaacggtacggttgtagtaatccagaccacgcaccagacgctggtttacggtgtaagcgatccccgcgctctccagcagtttgcacagaccggcaaaatgctcacgagattcctcgtccagatagtcacctaatgccggagcgtcgttgagaagcgcctgcacttccggattttttgaatccagcacgcgcagcgggttagtgtacatgcggcgtttgcagtcttcgtccagcttttctttatgctgctcaaggaatgccaccagcgcatcgcggtaattggcgcgtgcttccagcgaaccgatagagttcagctcaagagttacgtgctcggaaatacccagcgcgcgccaccagcgggcagtgagcataatcagttcagcgtcgatatccggaccttgcagaccgaaaacttcgcagcccaactgatggaactgacgataacgccctttctgcggacgctcgtgacggaacatcggcccgatataccacagacgctgttcctgattgtacagaagaccatgctcgatgccggcgcgtacacagcccgccgtcccttcagggcgcagagtcaggctgtcgccattgcgatcctcaaaggtgtacatctctttttcaaccacgtcggtgacttcaccaatcgcacgtttgaatagcggggtctgctctacaatcggcaagcggatttcactgtaaccgtagctgccgagcacgtttttcagtgtgccttcaatgcgctgccagatggccgtttcgccaggcaggtaatcgttcatgccgcgaatggcttgaatgttttttgccacgtttattctctttctgaatataaaaatgaaccctcaacgcttccctcaatgtttcgggagccatgcgggttcaatcatacacgggaagcgaggcgcttcccatcacgttattatttttcaacctgctgaacgtcaattcgacgcgcttcgtccagctgactggctttcgcacgaatgcgtgcttccagctggtcgatcatatcgttgttgtccagacggtctttgcgcacgccatcttcatagaggccgcttttcttgttgccgccggtgacgccgagtgtagaaaccagcgcctcacctgggccattcaccacgcagccgataatcgaaacgtccatcggagtgatgatatcttccaggcgttgctccagcgcgttaaccgtaccgataacatcaaattcctgacgcgaacaggtcgggcaggcgatgaagttgatccctcgcgaacggatacgcagcgatttcaaaatatcgaaaccgactttgatctcttcgaccggatcggccgccagcgatacgcgcagcgtgtcgccgatgccttcagacagcagcagacctaaaccaatggcggattttactgccccgctgcgcgcaccaccggcttcggtgatccccagatgcaacggctgatcgatctgttttgccagcaaacgataagactcaacagcgaggaagacgtcagacgctttcacgctgactttgaactgatcgaagttcaggcgatcgagatgatcaacatgacgcatggcagattccagcaacgcctgcggcgtcggttcgccatacttttcttgcagatctttttccagcgatccggcgttaacgccaatacggatcggaatgtttttatcgcgcgcacagtcaaccaccatgcgaatacgctcttcattaccgatattgccagggttaatacgcagacaatcgacgccgtattccgctactttcagcgcaatgcgatagtcgaagtggatgtcagccaccagcggcacgttaacctgctgtttgatgagtttgaacgcttctgccgcgtccatcgtcggtacggatacacggacgatatcagcgccaacgcgttccagcgccttgatttgattgaccgttgcttcgacgtctgtcgtacgcgtattggtcatggactgtacggcgatgggagcaccatcgccaatcggcacattcccaacgtaaatacgtgttgattttctacgttgaattggagcctggttatgcatgaaaaatctcccgcgttacccgtctgttactgcgccggtgattgttcggcattgagggtcagacgcgcaacctggttagttctgataaaacgactcagatcgacaggtttcccttgatactggatctgtactgcggctggcgcaccaattttcagtttgtacggtgcctggccggttaagttcaaattaccgtctttacgctgcataccgctaaacaattttttaccggtagcatcagtgacctccagccagcaatcggcagtaaagttcatcaccagcgcattcggatcagccaccggcgtggtcacgccagcctgatcggttggcaacggcgcagcaccatctggcgttgttgctgccgttggtgccggggtcgcggcggtatcaacatttgcctgcgaaggcgaaacaaccgcattctgttgcggatcaacagctggtgctggcgcagttacggcaggtgtttgcgtgttggttgcggtagtatccacagacgctggcggcgtggacgttgtagccgggtctgtagttgtcgacgtatttaatggaacactctgcccctgctcgctattactgctcagttccgccgaagattgatcggccatagtggtgatctcttcctgctgagctttgcggtcttgccaccaccaggcaccgctcaggccgataaccacaaacaacaccagccaagtgaaggtcatcagccagccgtcgcgttttttgcggcgtttaccgagggaaaaactctgcatcggcgcaacttttgcagcccgaagtggagcctgcttttccagccctggcagcagttcttcttctggaatatgtaccagacgcgcataagagcggatatatccgcgcaggaatgttgaagcaagatcggcgggtgccttatcttcttcaatgtcgcgtaccgtggaaaccttcaggcaaagtcgctcggcaacggcctgctgactaagtcctagttgttcgcgagcattacgcaggcgagcgccggtagtaagtgcttcattttggtcgtgcgtggcttcagtattcattcgctgcaggtacgtttaaatgagaattgagatgccggtgaaccatcatgctcacccacaccgcgaaacatccgttaagttaaccgttatcatacagtataagaccgtctgtgtgctcgtgacaaagcccacattcactaaggctaacttactgttgcatcgttacatactgccttaaagtcagcaaaaacgcaccgttaatattgaccagacaattgcaacttaatacttcattcataaaacattacgccacggtacataaagtaaccgtggcgtaatggctatcagaccgctttaatgtcgatggcttcaccctgcatccgtttacgcagggtacgtttcgtacggtcgataacatcgcccgccaactgaccacaggcagcatcgatatcatcaccacgagttttacgcacaatagtggtgaaaccgtagctcatcagcacttttgagaaacggtcgatacggctgttcgagctgcgtccatacggcgcacccgggaacgggttccacgggatcaggttgatcttacacggcgtatctttcagcagttccgccagttggtgcgcgtgttcagtgccgtcgttaacgtggtcaagcatcacgtattcaatagtgactcggccctgattggcgttggatttctccagataacggcgcaccgcagcaaggaacgtttcgatattgtactttttgttgatcggcacaatttcgtcacgaatttcgtcgttcggcgcgtgcagggaaattgccagtgcaacgtcgatcatatcgcccagtttatccagcgccggaactacaccggaagtggaaagcgtgacgcgacgtttagacaggccaaaaccgaaatcatcaagcatgatttccatcgccggaacgacgttgttcaggttgagcagcggctcgcccatgcccatcatcactacgttagtgatcggacgctgaccggtgacttttgctgcgccgacgattttcgccgcacgccacacctggccgataatttccgacacccgcaggttgcggttaaagccctgctgggcggtggaacagaatttacactccagcgcacaccccacctgcgaagagacgcagagcgtggcacggtcgtcttccgggatatacaccgtttcgacgcgctgatcgccaacggcgatcgcccatttaatggtgccgtcagatgaacgctgttcttcaaccacttccggtgcgcggatttccgccacctctttcagtttgccgcgcaacactttgttgatgtcggtcatctcatcaaagttgtcgcagcaatagtgatacatccacttcatcacctgatcggcgcggaagggtttttcacctaaatctttaaaaaactcccgcatctgctgacggttgagatccagcaggttgatttttccatctttcgtggtgacgttttcaggtgtgactaattgttcagacatatgctattccggcctcgttattacacgttatggcccctggagggttgaaaaaagaaacgccccggtgagcggctgctcgtccgggggcgctgcattgtacaaattctggcgcacggatgccacgtttgcacgcggcatttacgaaattattaacgggtgcgcgggcacacttcgccttcgccaaagaaataagcgatttcgcgagcggcagattcgacggaatcagaaccgtgggtaccgttttcggtcaggctgtcagcgtaatcagcgcgcagagtaccagccagtgcgtttgccggattggtcgcgcccagcagatcgcggtgacgctgaacggcgttttcaccttccagcacggaaaccacgatcgggccagaggtcatgaattcaaccagaccatcaaagaacggttttccatcgtgttcagcataaaagccacgtgcctgttcaacggtcaggtgcagcattttggtgccaacaattttgaaccctgcagcttcaaagcgcgcaaagatattaccaatgacgttttttgctaccgcgttcggtttgatgatggaaaaagtacgttcaatagccatttttacctctgtaaattgttctgttgttgtctgtaccagcgtacgagatggcgcggattataatgagcaacagggccgttgactattgatgaaggtaacatttttttaaaataaaatgagttttagcaacaatcagggacaaaacagactattgcatgacaaatttcactgtcgcgatttgccccacgtcatccatcaccagcaattgataatcacctttatccgtcaaatgcagggtcacgttgcgcccgcgttcagttaacggttcgccattcagaaaccaccagcgttcacctgcccctccacttgattgcaacggcaaagtcgcttccgctgcgcccggtaaacgtttaataatcgcgccatcgcgaacgcctgtcagctgcagcgggagctgggcatcgtgaccgtatggcgggcaacttgtcgaggccggtggtaagcgcacagcgcgacgttctgatgcgggcagccagggttccagcggtagcggccagacatttatcatttcttgtcgcgcttgcgggcaatcagcggcaacacgtttgccattttcatccagccagatggggaaacgaatgccattaatgccttcctgctccggcagtaatagagttggcggctgactcccgtccagcagccaggttgccaggcggcggcgacagttaccgtcaccttccggcaaagactgtccgcccggccagcagataacgccacgagtgactgagttcgggcgcgggtcttccggcagattcgcactgcgcgacagtaagatattattgacctgattcaacaatggtacggcactggcaaagccaaactgaccaacaacgggcgtgccgtccggtctgccagtccagatcccaatgacatagcgagcgttaaccccaatcgcccaggcgtcacgatagccatagctggtgcccgttttccatgccagtggggcgacgcgcggcaaggcactatccggcaagggttgcgcttcatcagccataatccggcgaatgatccacgccgcccccgacgacattaaaggccgttcaagcagcggatcgtcaggctgtaagcgcaatttgcctgccttgccgtggcgagcaaacgcggtatacgctgccgccatatcttccagttttgcaccagcgccgccgagaatgagtgaaagattcggcgcagcaccgttgggcaaatataacggcaatccaacattgcgtaactttgccgcaaaccgtttcggtccataggcttccagcacctgcacagcaggtaagttcagcgagcgcaccagcgcctcgctcatgctgatcgggccatgaaaaccgctatcaaagttacctggtcgataatcaccggtgcgccgggggacgtcttgcagcagtgatgccgggtggatcaagccttcatccagcgccagaccataaacaaacggtttgagcactgatcctggcgatcggatcgaattgaccatatcaacatgaccaaagcgtgaatcatcgttgagatcaaccgatcccacccagccgcgaacacgcatatcggtatgatcaaccacgatcatcgccagtgagctgcgcggtggcaaccgccctttccagttttgcgccagttcttccagacgtcgttgaagaccggcatccaacgtagtagtgattttgtcgcttttgcttttaccgagcatcatgcgcgaaaacagcggtgccagttgcggcatttgtcggggggccagccagatgggttcttcccttgactcttttacctgctcacgggaccacacaccttgcacggccatccgttcgagcactttattacgcgcggcttcggcacgctccggccaacgatccgggcgaagacggctgggcgcttgcggcaaaaccgccagcattgccgcctcggaatagcttaaattcgcaggcgattttccgagataagcccaacttgccgcaccgatcccctgcaacgtaccgccaaacggagcgcggttaagatacaaggtcagaatttcacgcttagacagatgccattccagttgcaacgcgcgccagagctggcgaattttgccgccaaatgttttggggtgaggatcaagcagacgagcaacctgcatagtgagcgtgctgccaccggaaataacccgtcccgaagtgagatcttgccatgctgcgcgcgccaccgagaatggattcacccccggatgcttccagaaccagcgatcttcataattgatcagcgcttcaaggtaacgtggagaaacatcttcgattgttaccggataacgccagatgccgtcagcatcggcgaagcgccagagcggcgtaccatcctgcgccacgaccactcgtgcgggattgacttcatgcagcggtagaggccagagtttatctgctccccacgctgcaagaaaaaggagaaagggcgcggctgccaacgttatccagcagccgcgtttggttaacaagcgaggcatttacggtctgacaatcagcagatcttcagccgcgccggtcgcccgccattggggaacatacattgattccaccatcggttgcggtacctgatacgttcccggcgtcaccgcccgcgccagatacaccagcgttaccggttggtattcatcaacggcaaccgccgccacaaagcgatcgtcacggaactcaatgtgcttaatgctcgcctgctgcatctggttcagtaagttctgcacttcgccaccactttgctccaggctggcgctaccgttcgccagattctggttttccagttccagacccgcaggcagcagatccacgactaacgcatccggcacgctgttactggcttttacctgcaaccacaccagcaccagatcgccgctacgtaacgagtccagcgatttgctcttaccatcagtaccaagaatatgacgctcgatttgcagcacattgttcgccggtaaaggtgcggattgcggataaccgctggcatccatacgcaaccataacggctgatcgccactgttgctcacctgcaaggtgacaagttgatcgctattcagattgctgttttgcgctttctcgcctgtcagctgctcagctgagaaagaggtttgcgcctgccatttaccgggtaaatcctgaatcgtacgggcagccaggaacaacgcgttactttcctgcgtcgatagccagcgttcaccaaacgcctgctgcgaaagtgtgttcagcaaagtgtactgctcatcgggtagcagtttattttcttccagcaaggagagcattaacgcgttgtcgcgcagtgaactaccgtaatcacccagccatatccgctcatcactattacgcggcgttttcagcgccagcgcaatcgcttcttcaccacgcgtcgcatcacccatggttttcagcgcaacgccaagttgcagcagcggtaaaccagaagcggcatctgcacgatgctcccagatttcacgcagcgcacccagcggagccttttgctgacgggccaacaccagcgcagcgtaagactgtacggcgaatttactggctttgagattatccgcgtacgggatcgacatcatgcccggatcttgtaaatagcgcagcagacgctcattaccccggttaatggcgtctgtcggcacgctgtaaccctgttcgcctgcgcggaccaggaaatccatcacgtaagccgtcagccagtactcttcgtcaccgtttttatcccacagcgcaaagccgccgttatcacgttgcatttgcagcaaacgggaaatgccgatatcgaccgatgcacggcgtttctcatcactgtcgcctttgatgcccaacgcctgcagttgggctgcgttggtataaagtgacggaaacaggccgctggcggtttgctcaagacagccgtacggatacgcttttaactctttgatataacgtgcgatgttcagcggtggtttgccgctcaacaacaattgcccttccagcgtaacaggcgagaagttttgcaatccatccgccggaatcgcccatgtctcaccaggctgtaacgccgtaccgtaattaaccgtttgtgccgggaacgccggacggacgccgattttccactgcttatgctgatcggcaacggtttcacccggtaacgctaacccgctaatggtggcctgaatttctccatcgccataacccggcaatgctcgcaccgggataaacagcgtagtacgcacacctggcgctaattcaacggctgcgggtgaatcgctgaccagttcaagcaaaccactggcggtcagggcaacgttcagtttttgcggtttatcggtaagattagtgatatccagcgtcagacgcgaggtatcgccactcgccataaagcgcggcatgttcagttcagcaatcaccggtgcggcaactatcactttactttcgttgctaccgaagtcatctgccgtccaggcttgcgccatgacgcgcaattcaccgttaaaatcgccaatcggcagtgtaaccgagccttcgccctgttcgttgagcgttaccggcagcgcctgctgcacgacaatattgacgtgattgaccggcggtttaccaccacgtttcagctcatcaccatcgccaccgaaacgcagagctgccagacgcccctgaccttcaataacctgaccgtaaatatcgtaaatgtctgcgccatagcgtttctgaccaaagaacgcctgccacggatctggcgtgacgtagtcagtaatattcagcacaccactatcaacggcagacaccagcacattcacctgtttaggcttctcgccatttttagtgctggctttaattttcacggttaatggttgattgggacgcatttttgctggtgtttccagcgccagatcgaggcgacggttttcatcgccaagcggcagatgcaacacaccaaccgcgcgttttggcgtcgcggagcgagatttatcgccaggacgtaccaccagcgtacttaaatacagatcatgacgattccaggttttatcgaccggaatcgtcagatccagcccttgagcccgaacatcaatctcttgccaccacagcggcccttcactggactcgaccatcgcataacctttacccgccgttggcgcggcgatatgcaacttaatggtgtcgccagggcgataactggctttatccagtttcagcgtgacacggtcgggtcgcactgcgccgctaccgtcgctgttgtcctgccagctatagccagcccagaaacgaacactactgaccgcttcattcggcgctttgacttccagacgataagcgccccactctaccggaaaactgaccttgccggtttcgtccgctttcagatccagagtttgttcattttcgatcagatctttttgatcaaactgtgactgccagccttcatcttctgaccagttccagtagtaatcgcggcgttcgcgaatcaggcgcacctgcaagcccgacacggcttttttcacgccttgcgcatcgctataaacgatgtcaaaagcggcgttactgccttcatcaacaatgggctgtttcaccgtgctgtcagtacgataatcgtaaaccgatttcgaggcgaactgcggacggatccccggcaatgcatcggcaggccagatagcctgctcagcgcggcgcgtcaccgggcgaccgcccgattccagcaaactaccctggaaaataacctgtaatggggaatgcgtttccttccactggctttctgtagaaacttcgccgcgccctttatcatccagcgtcaactgaacttcatccagcgtgcgggaaagattttcggcagctatatcgccgaattcaaaaccaggtaaggctgacacagcttcacgcagtgggcgcaggaaaagttgcccttgcaaagtattaccattagcaggtgcaccatacaggtagtaccccaccacggagaatttcacttcatctttcggcgttagcggggttttctcaccggtcagattcagcgccatgcgctctggcataaaatcttcgacgtggaaatcccacatccgatactgattatcgcccgtgttagcgcgaatatgccacataccggttgccgcattgctatcgagtggccaggtaaagtggtagaggccattctccggctgactaacgacgctcctgagtacctgcccatcgggtttaatcacgtctaacttgatgggttgattgggcaacgctttaccgtctgcatcacgcagcaaaccattgaggattaccgtttcacctgggcgataaagatcgcgtgggccaaacatgaaaaactgtttgctatagcctggcgcgccagcaatgttaaattctgctaagtccagcgccggaagttttaaatcgagtagcgttgtctgaccgtctttacgcgccaacagtaatgccgcgtttttatcattttccagctgcacatgcccctgagcgtcactggttgcctgagtcagagtctgccctttctcatttaataaagagacttcaattccttgctgggccgcgccgttttccagactttgggtaaagatatccagacgattgtgataacggtgagctgaaacgccgatatcacttaacgtaaacagcgtcgcgggattactgtaatcgtaacgtccagcctgattcatcacagccagatacacgcccgcctgctgaagcggtttgatatcgcccagcggcagcaataatttttcacgggtgttacgcgcaggattgagatcaaaccgtccggtgtagaccagatccgccatctgcagcagtttgtctgactgccagttcgccagcgaattgcggtattcccattggctaatgaatgctggcagagattctggcttaacgcggaagaagttaacatcgacattattaacgttgagcgccattaccggcagcccttcaacgactttgccaggcagcagcgaaccacggctggcaaaaccgacgctgggttggatgtcgcgggtagttatagttttttcgtaatctttactgaaggttgcgttgttgagtgctttgacctccttgccaatagtaacgatcaaatcacgtttcggttcgaggtggcgtaaacgtaactctttaagattatctgacagctcccaggcaccatccactttgccgctttttttatcgacgacatgaataacgcgtgagaaatcctgatccgggtcgagagggatggagaacgtcagcaccagcgtggctgcaccatcaagttggacttcagagagatccagcaatgtcagcaccttaccggcactctgttgggccagtttttgtctctccggcacggagagttttgctgaactcgcgttttctgaagaggccgctttagtaacttcagaaggcgcatcttttttcaccgctgttggcgcgttatcgttgttgtcgcaccctgccagcgccagcattagcatgcaggcggctacgcgtaactttttcatttttcatccctgccacaatggcccgttagcaacgtcgaataattattatgcgtgagaatttacgttatgtaattcagtatcacgcccatacaatccgaattttagtgagaattgtggctcagacagccaaatcagcctcttttgcttgtcgcttttcactaaacatccgacaatttagcctaaccccggcaaaaatggagatgcctatgtccacgacatggtttgtaggagccgactggctcgccgaacatattgatgacccggaaattcagattatcgatgcccgcatggcgtcgcctggacaggaggatcgtaacgttgctcaggagtatctgaatggacatattcccggcgcagtgttttttgatatcgaagcgctttctgatcacacttccccgcttccgcacatgctgccgcgcccggaaacgttcgccgtggcgatgcgtgaattaggcgttaaccaggataagcacctgattgtctatgacgaaggtaatcttttctcagccccacgagcatggtggatgctgcgcacctttggtgtagagaaagtgtcgattctggggggtggacttgcaggctggcagcgcgatgatctgctgttagaagaaggtgcagtagagctgccggaaggagagtttaacgccgcgtttaatcctgaagccgtggtgaaagtaaccgatgtattattggcaagccatgaaaatacggcgcaaattattgatgcccgcccggctgcacgttttaacgcagaagttgatgaacctcgcccaggtttacgtcgcggacatattcccggagcactgaatgttccgtggacggaactggtgcgcgaaggcgaactaaaaacgaccgatgaactggatgcgatattttttggtcgcggcgtcagctacgacaaaccaattatcgtcagctgcggctctggtgtaacggcagccgtggttttgttagcactcgcgacgctggatgtgccaaacgtgaaactgtacgacggcgcatggagtgaatggggcgcgcgggcagatttaccggttgagccagtgaaataagtattttacaggcaataaaaaaccgccgaatttggcggttttttattgctagtctggttcgcggcctttccagcaggttgacttgtgttacatgagcaacgcaggtgcttcacagcaaaacaatactcaccagtaactctctttttgtcaagcaaaagagagtaattattgtttatttagcgtattatcgacaccggccctttccgccgtgttcggtaataaaataacctggcttattagtccgaattcagacaaatataaataaatcctgctcaaaattaaaaattctaaccggtaaaagatattacttaaacatgtaaattcactttcctttaaaaaacaaaaaaccgccaaaatcaggcggttttttgttgctggtccggttcgcggcctttccagcaggttgtattaccgtagtaatgcaagcgcgtctcagcggagacaatactcgccagtaactctctttttgtcaagcaaaagagagttattattgttctgttagtgtattatccactgcggccctttccgccgtctcgcaaacgggcgctggctttaggaaaggatgttccgtggccgtaaatgcaggtgtttcacagcgcttgctatcgcggcaatatcgccagtggtgctgtcgtgatgcggtcttcgcatggaccgcacaatgaagatacggtgcttttgtatcgtacttattgtttctggtgcgctgttaaccgaggtaaataataaccggagtctctccggcgacaatttactggtggttaacaaccttcagagcagcaagtaagcccgaatgccgccctttgggcggcatattttagattatccgattctgtttaaagtcacgcaaaaaaccaccccagcgacgttcatagaatggcgcaatatgttcggtaataaagtggctaattcctttttccccttttttcacctgacaaatatcgattggttcatcgccaggtaatgtatcggtcgctacacttcccgtcgcctgaataatttcttcgatatcaccatcggcttcaatgccaataagtaaattaggctgtgcctcttcgttctctttaattgaacaaataaaagcacgcttcaccggcttaatggttttaaataaggtggtgagtgaatcaatcatttgtgctggcggctctgcgacttccgataatatcagcgattcaccgccttccaggatttcctggctgctcagcggatttccctcttcaccaatcaacaaactgatttcacgcggcataaattctttaccggttggcagtttggcattaaggaagagcgtttcgccaagtgtcatctcaaacagcgtgcgaacgggcattacgacaaatgcctgttcgtcttcaaccgcctgttgaagtgcttctaacgaggtgaaaaaaggaatgacgctggtgccgtcttctttttcccagtgctgtaaatcaagcgcgctatcttcaaccacagcctcgccctgcgccgccgtaccaggcacccagacggtggattccagtagagtacggaaaaaggccgggcggtgcgccggttcagttgctgctttttccagcaggtcttcaagttcgttttttgtttcggacataagaaccacaattcattcaacgttcggggcgcaaatgcctgatgcgctacgcttatcaggcctacaagggattcgcaatttgttgaatttgcagaatttgtaggccggataaggcgtttacgccgcatccggcatattagtttacgccgttaacagattagctatcgtgcgcacaccaagtcccgtagcgcccgcagaccactgttcaaccggcgctttacggtaagtcgccgagcagtcgatatgcagccagccttgctgatagttctcaacaaagtgcgacaggaagcccgccgccgtgctcgcgcctgccggatacgccgcgcttccggtattgttcagttcggcaaagttagacggcagctggctgcggtggaactccgccagcggcagacgccagaacggttcgttctcctgcgcggcactcgccagcaagcgaccggccagcgcatcgtcaaaactgaacagcgcgtgataatcattacccagcgcagttttcgccgccccggtgagggtcgccgcatcaatgatcatttccggtttctgcgcactggcatcaatcagaccatcggcaagcaccagacgcccttcggcatcagtgttcatcacttcaacttttttaccgttgcgataggtgatgatatcgcccagcttgaacgcattgccgctaatcaggttatccgcacagcagaggaacagcttcacgcgcttgttcagtccgcgcgtaatggcaaatgccagcgccccggtaaccgttgccgcgccgcccatgtccgacttcatcgagtccataaacgcagtctgtttgatgctgtagccgccggagtcaaaagtgatacctttacctaccaggcacgcgtacactggcgcttctttatcgccagttgggttgtaatccagcgccagcaataccggagaacgttctgaaccgcgtccgactgtgtgcagccccatataaccttgctcacgcagatcttcgcctttggtgatccgataagtcacacgatcgcccgcgacgttgctgatcagatcaacagcacgctgtgccagttgcgatggtcccaattcttctgccggtgcgttgatggtgtcacgcacccagtcgatgatcatcaggcggttatccagttcctggcgctgggcatcgtccagatccggccacaccactttacgcgtgcctttcggggctttgtaaccttgccagaatgcccagcagcgatccgcatcccagccttcaccgcttaactgaacatgcttgatgcccagaccgtcaatcttgcgcgccgcacgctggatcagccccagatcgtctgccccgttcaaatgcagggtaatgccgtcattattaatgctgtaagttgctttttctccccagcgcgcgtcggcaggttgggtagagagggtaatcttcatcgcttctgtcattttagttatccttctttgtaaaagggccgccagttggcagccccaggatttttccgctaaatgattcgcgttgcaggaaggcggcaagtgagtgaagccccaggagcatagataactatgtgactggggtgaacgagcgcagccaacgcatctgcggcgtgaagcatgacgcggaaattattcggcctcgtccagccagactaacaaaatcgcttcgaggattttctcgttggatgcctgcgggtcgtcgtcgaaatcttccagatcgcaaatccactgatgcatatcggtgaatcgaaccgttttcggatcaagatcgggatacgcatcgtacagtgcttcgccaatttcgcggctatcggtccacttaagtcccatactaacctctgttaatgctcacgcgcatggttgatagtgtaacgcgggatttcgactactaaatcttcgtcggtaacgcgcgcctggcagcttaaacggctttccggctccagtccccaggctttgtccagcatgtcgtcttcctgctctgagctttccggcagtgagtcaaaaccttcacgaacgatgcagtggcaggtggtgcaagcacaggatttttcacaggcgtgttcaatctcgataccgttacgcagagctgcgtcgagaatggtttcaccgctattagcttccagaacagcgccatcagggcagagatcctgatgaggcaaaataacaatctttggcatattaaacctcgtccacggaatggcctttcagcgcacgacgaaccgactggtccatgcggcgagcggcgaaatcctgggtttgtttgtctacgtttttaatcgcttgttcgatggcgtcaacatcatcgccctgcgccacttcactcaggtgagcggcagcatcgtcaatgacctgacgttctgcggcgcttaacagcgcggcatcagcagccagcgcgccgtgcagactttccagcacacgcgccgcttctactttttgttctgccagcattcgggcttttacgtcctgctcggcatagctcattgagtctttgatcatcgaagcgatttcgctatcggtcagaccgtaagacggtttgacctgaatagacgcctcaacgccggtggatttctccatcgccgtcacgctcaaaagaccgtcggcatcgacctggaacgtcacgcgaatatgcgcaccgccagccggtagcgccggaataccacgcagcgcaaaacgcgccagtgagcggcagtcctgcaccagttcgcgctcaccctgcattacatggatagacatcgccgtctgaccatctttaaaggtggtgaaatcctgagcgcgggccaccggaatagtggtattacgcggaatcactttctccaccaggccgcccatcgtttcgaggcccagcgacagtgggatcacatcaagcaacagcatttcgctgtctggcttgttacccaccagaatatccgcctgaatcgccgcgccaatagcgacgactttatccgggtcgatggaagtcagcggtggacgaccgaaaaattcgcctacccgttcacgcaccagcggcacgcgagtagaaccgcccaccatcaccacttccagcacttcatcagcttctacacccgcgtctttcagcgcgcgacgacaagccagtaaggttcgttttaccagtggcgcgatcagttcattgaattgttcacggctgatttcgccctgccagcccgcaacgttaacggtcacggagtccgcatcgctcagcgcgattttggctgcaatggcggcatccagcagttcacgctgaacgcggttatcgctacgatcaggaatgcccgcctgctcgcgaatgtaatccgccagcagatggtcgaaatcatcgccgccgagcgcggaatcaccgccggttgccagcacttcaaacacgccgcgacttaagcgcagaatggaaatatcaaacgtcccgccaccgaggtcataaacggcgatcacgccttcctgaccggaatccagcccgtaggcgatagccgcagcggtcggttcgttaagtaagcgcaggacgtgaaggcccgccagacgcgccgcgtctttggtgccctgacgctgggcatcgtcaaagtacgccggaacggtgataactacaccatccagctcgcctgccagggcttcagttgcccgcgccgccagtgctttgaggatgtccgcagaaacgcgcaccgggttcagcagccccgccgccgtttcaatcatcggcaggccgttttcgctggcctggaattgataaggcagatgcggatagcgttgctggatatcagccagcgagcgtcccatcaggcgtttaacagaactaattgtgttggcggtatcgagcgctgcattagtacgcgcgtcataacccaccgaatgcccttgctgttgatagtgaacaacagatggcagcaggtgacggccttcatgatcggctaacgtttcggcctgaccgctgcgcactgtcgccaccagcgagttggttgtgcccaggtcaataccggccgccagacgacgctgatgcggcgcagcactcaaaccaggttcactaatttgtaataaggccatgtttagcttccagaaattaaaaatcgagcagtttttcttcgagttgttcggcactgcttcgcagtttatcgagaaaacgcagcttacgcacggtatccgccgccgcgtcccacgtctcgttgtctaactgttcaaccatcaactgatggcgggtatcaaacatctttttcacacgtttgataaagctttccagccgcgcttcatctttcgcctgttcgatctcgtccagctcttcgcgcagctccaactgttccatcaggaacgcggtgtcgcgcacagtatgctgctcgctggcgagatcaaagccgtgcaaagaaagcaaatattccgcgcgcattaacggatgacgcagcgtttgccaggcctggttaatggttgcagattgctgtacggcggcgagttgttccgcctggcttccgctggcgaatttatcaggatgatactgacgttgtagatcctgaaaacgcaggctcagcgcctgggtatcgagttgatagcgggcaggcaagccaaagagggtgaagtaatccataacattctcagggctgcgatccgccgcgataacggcgaatcaggtaaaacaaaccccacgcgcaggcgaccacggtggggttatcggtatgcgcatcaaacgtggaagctttcgccgcaaccacactcatctttgacgttcgggttggtgaatttaaacccttcgttcaggccttcttttacgaagtccagctgcgtaccgtccagaaattgcaggctcttgccatcgaccacgactttcacgcctttgtcttcaaacacgatgtcttccggcgtcggttcgtcaacaaattccagtacataagccatacctgaacacccggaggttctcacgcccagacgcaggccaaaccctttaccgcggttagccagaaaggtatttactcgcgctgctgcactgtcgctcagtgtaatcgacataaccaaacctcaactcttattttgcttcacgtttgcttttatagtccgcaatggcggctttgatcgcgtcttctgccagaatagaacagtgaattttcaccggcggcagttcaagttcttcagcaatatcggtgtttttgatcgcctgcgcttcgtcgagagacttccctttcacccattcggtgaccagggagctggaagcgatagcggaaccgcagccgtaagttttaaaacgcgcgtcttcaatgataccttcatcgttgactttaatctgcaacttcatcacgtcgccacaggccggtgcccccaccatgccgctgccgacgttctcgtcgttgttgtcaaaggaacccacgttacgcggattctcgtaatggtcgataactttttcgctgtaagccattataaattctcctgattccgataccgattaatgatgagcccattcgatgctgttcagatccacgccctgcttgtacatttcccacagcggagaaaggtcacgcagacgaccgatggatttacgaactaactcgatggtgtagtcgatctcttcttcagtagtaaaacgacctaaagagaaacggatagagctatgtgccagctcgtcgttcagccccagcgcgcgcagcacgtaggacggttcgaggcttgctgacgtacaggcggaacctgaagaaactgcgaggtctttcagcgccataatcagcgactcaccttcaacgtagttgaagctgacgttgagaatgttcggcgcaccgtgttccaggtcaccgttcaggtaaacttcttcgatatctttgatgccgttccacagacggttacgcaggccgcgcagacgttccatctcggtcgccatctcttcttttgcgatgcgataggcctcgcccattccgacgatctggtgaacaggcagagtgccggaacgcataccgcgctcgtgaccgccgccgtgcatttgcgcttcgatgcgtacgcgcggtttacgacgtacatacagcgcaccgatacctttcgggccatagattttgtgaccggagaaagacatcaggtcaactttcaactggctcaggtcgataggcagtttacccacgctctgggttgcatcaacgtgatagataatgccacgagcacggcacatttcgccgatagccgcgatatcctgcaccacgccgatttcgttatttacgtgcatgatggacacgaggatggtgtcgtcacgcatcgctgcttcaagttctttcaggtcgataatgccgttacgctgcggtgccaggtaggtgacttcaaaaccttcgcgctccagctgacggcaggtatccagtaccgctttgtgttcggttttgctggtgatgatgtgcttgccttttttctgataaaagttggctgcacctttgatcgccaggttgtcagattcggttgcaccagaggtaaagacgatttcacgcggatcagcgccgaccagatcggcaatctgattacgggcgatatctaccgcttcttcagcctgccagccgaaacggtgagaacgggaggccgggttaccaaaggttccgtccatcgtcataaactgcatcattttctcggcaacacgcgggtccaccggcgtggttgcggagtagtcgagataaatcggtaatttcattgctctataaactccgtacatcactcaatgcaaggaatcaggctaccggctggatgtacgaccgtgtttacggagtatttagcactccggcctgattctgaattctttttattaagcgcgtaacttaacgtcgatcgcgtcttgtgtgcgggtgcgtggcgcgtcgtgagtatgctgacgaccagacacatccagcacttcctggttattaaccagttcgcctaaagtaatgttgttgagaaaaccggtgagacggtcgctcaaatcacgccacagcgcgtgggtcaggcatttatcgccgccctggcagccgcctttaccctgacaacgggtggcatctacagattcgtcaacggcgctaattacttcgccaacggcgatgctgctggcatctttgcctaacagataaccaccgcctggtccacgtacgctggaaaccagaccatttttacgcagacgggaaaacagttgttccagataagaaagggaaattccctgacgttcggaaatatcagccaacggtaccgggcccgcttcagagttgagcgcaacgtcaagcattgcggtcacggcatagcgccctttagatgtcagtctcatgtcttacttcacctcaaactcgcccctgcccggggttttttattgtaaaagtgggggtattgcatagcagggtcaagtctgacattcccgagtaaattggtcaactatttacttgactgatttagtcgggtatttaaccttcagtgccatttttttatcgtggcgtttgtacctgttgtcggatgcggcgtgaacgccatatccgccctggggttctgtacactgtaggcctgataagacgcattacgcgtcgcatcaggcaacggctgtcggatgcggcgtgaacgccttatccgacctacggttctgttcactgtaggcctgataagacgcattacgcgtcgcatcaggcaacggctgtcggatgcggcgtgaacgccttatccgacctacggttctgttcactgtaggcctgataagacgcattacgcgtcgcatcaggcaacggctgttattcggccttgttacctttattctgctgctcaatagaagccagaatcccgcgcaggatattcaactcctggctttccgggcgcgcacgggtaaacagacggcgcaatttattcatcacctgccccggatggttttcacggataaaaccggttgccagcagcgtttgttccagatgaccataaaaacgctccagatcatcgaccagcggatacggcgtctcttcatgctcgacctgctcgccgttttcctgagttgccagccaggccatgcgcacttcataggcaataacctgaaccgccatcgccaggttcagcgagctgtattccgggttagccgcaatcgcgacatgataatggcatttctgcaactcttcattggtcaagccgacgcgctcgcgaccaaacaccagcgccaccggggtatttgccgcttcagcgacgcttttcaggccgcattcgcgcgggtcgagcatcggccatggcagcgtgcgggaacgtgcgctggtgcccaccaccaggctacaaccggctaacgcttcgtcgagcgtatcgacgatgtgagcattaccaatcacatcgctggcccctgctgccagggcaatcgcctgggagtcgggtttcaccagtggattaaccagccacagattggttaatcccattgttttcatggcacgggcaacagaacccatattgccggtgtgtgacgtctccaccagcacaattcgaatattttgcagcattgtctttcttcatctaaagattattcacgcatcttatcataaaacgaagacagatgccgatctcgctgctatactctgcgccgttttcccgttctttaacatccagtgagagagaccgatgcatccgatgctgaacatcgccgtgcgcgcagcgcgcaaggcgggtaatttaattgccaaaaactatgaaaccccggacgctgtagaagcgagccagaaaggcagtaacgatttcgtgaccaacgtagataaagctgccgaagcggtgattatcgacacgattcgtaaatcttacccacagcacaccatcatcaccgaagaaagcggtgaacttgaaggtactgatcaggatgttcaatgggttatcgatccactggatggcactaccaactttatcaaacgtctgccgcacttcgcggtatctatcgctgttcgtatcaaaggccgcaccgaagttgctgtggtatacgatcctatgcgtaacgaactgttcaccgccactcgcggtcagggcgcacagctgaacggctaccgactgcgcggcagcaccgctcgcgatctcgacggtactattctggcgaccggcttcccgttcaaagcaaaacagtacgccactacctacatcaacatcgtcggcaaactgttcaacgaatgtgcagacttccgtcgtaccggttctgcggcgctggatctggcttacgtcgctgcgggtcgtgttgacggtttctttgaaatcggtctgcgcccgtgggacttcgccgcaggcgagctgctggttcgtgaagcgggcggcatcgtcagcgacttcaccggtggtcataactacatgctgaccggtaacatcgttgctggtaacccgcgcgttgttaaagccatgctggcgaacatgcgtgacgagttaagcgacgctctgaagcgttaatgactcaggcgggtgatatcactcacccgccctcgcctttcaggcgctattccgaaatacttcctcactgctttactttctttcgtcactctcccaccatctttccccgattaatggatgataaagaagtcgcaaggaaaggttatggcactgccagtgaacaaacgcgttcccaaaattctgtttattctctttgttgttgccttctgcgtttatttagtgccgcgcgttgccatcaacttcttctattatcccgacgataaaatttacggtcccgatccctggtcggcggaatccgtcgaatttacggctaaggacggtactcgtctgcaaggctggtttatcccttcttcgacgggccctgctgacaacgccatcgcaaccatcattcatgctcacggcaatgccggaaatatgtccgcccactggccgctggtcagttggttacccgagcgtaatttcaacgtttttatgtttgattatcgcgggtttggtaaatcaaaaggcacgccgtcccaggccggattgctggacgatacgcaaagtgccatcaatgtggtgcgccatcgcagtgatgtaaacccacaacgtctggtgctgttcgggcagagtattggcggggcgaatattctggatgttattggtcggggtgatcgtgaaggcatacgtgcggtgatcctcgactccacatttgcctcttatgcaaccatcgccaaccaaatgatccccggcagtggctacttacttgatgagagttacagcggcgaaaattatatcgccagcgtcagcccgatcccgcttttactcattcacggtaaagctgatcacgttatcccatggcagcacagcgaaaagttgtatagcctggcaaaagagccaaaacggttgatcctaatcccggatggcgaacacattgatgctttttccgatcgtcacggcgatgtttatcgcgaacagatggtggactttatccttagcgcgttgaatccgcagaactaacccatgatcgctagcacgataatcattcacaaaaccaccttaagacatgctaatccactggtcagaacagtttaagatgagaaaaattctgtgacgcttgccaacatttctgatgattagcattcccttcgccatttccttgagcaaactttagctattcttatcaattatgcttatgggagatctacagatgatgcctacgcttgctccaccatctgtcctttcggctccccagcgccgctgccagatcttgctgacgctctttcagccggggttgaccgccaccatggcaaccttcagcgagcttaatggtgtggatgatgatattgccagtcttgatatcagcgaaacaggacgggagatcctgcgctatcatcaactcacactgacgactggttatgacggtagctaccgggttgaaggtacagtgcttaaccaacgtttgtgtttatttcactggctacgacgtggtttccgtctgtgtccgtcatttattaccagccaattcacccccgccctgaagagtgaactgaagcggcgcggaattgcgcgtaacttttacgacgataccaatctacaagcgttagtgaatctctgctcccgacggctgcaaaaacgctttgaatcgcgcgatattcatttcctgtgtctgtatctgcaatattgtttgctgcagcaccacgctggaattacgcctcagtttaatccgctccaacgtcgctgggcggaatcctgccttgaatttcaggtagcgcaggaaattggacgccactggcagcgtcgggcgctccagcctgtaccacctgatgagccactgtttatggcactacttttttccatgttgcgggttcccgatccattgcgggatgcgcatcagcgggacagacaattgcgtcagtctatcaaacgtctggtaaaccattttcgtgagctgggaaatgttcgtttttatgatgaacaggggttatgtgatcagctttatacccacctcgcccaggcgttaaatcgcagtttgtttgccatcggtattgataataccctgccggaagagttcgccagactgtacccacgcctggtgcgcaccacccgcgcggcgctggccggatttgaaagtgaatacggcgtccatctttctgatgaggaaagtggtctggtcgcggtgattttcggtgcctggctaatgcaggaaaacgatctgcatgaaaaacagattattcttcttaccgggaatgatagcgagcgagaagcgcagattgagcagcagttacgcgaactaacgttactgccgctcaacattaagcatatgtcggtaaaggcatttttgcagacaggcgctccgcgtggcgcggcactgattattgcgccttataccatgccattaccgctcttttcaccaccgctgatctatacggacctgacgctgacaacacatcaacaggagcagatccgcaaaatgctcgaatcagcatgagggaacaactttcgggcgcaaaaacattgccggaagcgccaccagcgccattacccagaacacgccgtggcccagatattgatacaggaaaccggcgaaaacggtcatgatagcgatactgccgcccatcgcgacggcagagtaaaccgcctgtaaacggatgacttcgctaccctggcgagcagcaatataacgcatggcggccaggtggcagaccgtgaaggtgccgcaatgcagaatttgcaccactatcaaccacggcaacgccgtagttgctcccataatgccccagcgcactacgccgcaaatcgccgagatcaacagcatatcgcgtgcactacaacggcggaaaagtttattactcagcgcaaagataatgacttccgccaccacgcccagcgaccacaaataccccaccgccgaggccgagtagccagctgcctgccagtaaatggcgctaaaaccgtaataggccgcatgtgccccctgcaataaacaaacgcaggccagaaagcgccagttctggcgaaccagcgccaaccacgcagaccaaccggtgctctcctgctggcgacttgccccttgtggctgaatcgtcggacggatgagaaagccgagcagcatggatgccacgcccaacgtcaacagcgcgaggatcacccgataatcaaacatagtgaccagtttgcccgtcagcgccgagccaatgacaaacgccaccgagccccacagtcgcactttgccgtaatcaagcgggaactgcttttgccacgtattcgccagtgcatcggtcaacggtaccagtggtgagaaaaagaggttaaagccaatcatcaccagcatcagccacgctacgtgcgcccccgcccagaaggcgacagcaaagagaagtgtcagcagtgccagcacgcgcaaggcggaaatcaggcgggaaggatcgctgacgcggggcgcgatgagcaaactcccgaggaaacgggcaaccagacctgcccccaataacaggccgatggtttctggcgttaaaccaatccctttaagccagacgctccagaaaggtagaaaaatgccgtaactaaaaaagtatgtgaaatagccgagcgccaaccagcgcgtggattgcaaaaccatgagtccctcccgtcaggaggcgttagtctggggttaatcgaatgttggtgcaagttgaaaaataagaatattcgagcctgcttcccgatgtctgtaacgccagttcacaagcactaaaaaactgagatccgcgacgcatgttgcaaaaataatgcgtaattatgccgttacgcttgccaaacgttcctgcacaatggcgatgaaatcgcgtaatgccggcttcatctcccctttcttccacgccatcagtaaagcaatggaaggcacatttccggcaatgggacgaaaaacaacctgtccggtattaaaattattcatataaccgggtatcaaagtgacgcccagccccatgcccaccagattcatggtcaccagaatattcgttgccacctggacgatatttggctggctgttttcttgcgcaaaccacgctttaacgatcggcgcaagcgaaccggaatacaccggatcggtactgacgaaattcacgccatccagttgcgcggcggtgatctctttttcatgtgctaaagggtgatcaaccggtaacacaaccactaatggttcgtcaaaaagctccagataatcaatctccgggctataaacaggatggcgcattaagccgacgtcgagttcaccacggcgaattttttcctcctgttgcgtggtgattaaactcaccagctcaatcaaggtgtctggctgtctgagacgaaacatcggtaatacttttggcagtaaattcacttccgccgatggcacaaagccaatggttaattgtctgtcttcctgaacaattttccgcgcccgtaatttggcattttccgcttgttcgaggattgccagcgcgtcctggagaaaacattctcccgccgccgtcaacgcgactttgcgcttatccctcaccagtaacggaacaccgacacagttttcaagatcgcggatctggctgcttaacgaaggctgtgaggtatgcagtttttccgccgcacgggtaaagttcagtgcctgcgccactgcgacgaaatagcgtaaatgccgtagttccatcaccttccccttgttatcgaaaaaacgtctcagctggtagaaattaactatttcacatattagcaaccaaccagcaacatccttatggcacaaaaatagaaggtcaatacatcttatctttcaggattaaaaaatatgaccacaccctcagatttgaacatttaccaactgattgacacccaaaatggtcgggtcactccgcgtatttataccgacccggatatttaccaactggagcttgagcgtattttcggtcgttgctggctatttctcgcccacgaaagccagatcccaaaacccggtgatttctttaacacctacatgggagaagatgcggttgtcgtagtgcgtcagaaagacggcagcatcaaggcgtttctcaaccaatgccgccaccgggccatgcgtgtgagttatgcagattgcggcaacactcgcgcctttacctgcccgtatcacggctggtcttatggcattaacggcgagttgatcgatgtaccgctggaacctcgcgcctacccacaagggttgtgtaaatcccactggggactaaacgaagttccttgtgtggagagttataaagggctaatttttggcaactgggataccagcgcaccgggcctgcgtgattacctgggtgacattgcctggtatctggatggcatgctggatcgtcgcgaaggcggcaccgaaattgtcggcggcgtacaaaagtgggtgatcaactgtaactggaaattcccggcagagcagttcgccagtgaccagtatcatgctctgttcagccatgcttctgccgttcaggtattaggggcgaaagatgatggcagcgataagcgcctcggtgatggacaaaccgcccgcccggtgtgggaaaccgccaaagatgcgctgcaatttggtcaggacggtcacggtagcggtttcttctttactgaaaaaccggatgctaatgtctgggtcgatggcgcagtttcaagctattaccgcgaaacctatgccgaagcagaacaacgtttaggtgaagttcgcgccctgcgcctggcgggtcataacaatattttccccacgctttcatggctaaacggcactgccacactccgcgtctggcatccgcgcggccctgatcaagttgaagtgtgggcgttctgtattactgacaaagccgcctccgatgaagttaaagccgcttttgaaaacagcgccactcgtgcttttggtcctgctggttttctcgagcaggatgactcggagaactggtgtgaaatccagaaattgcttaaaggccaccgcgcccgcaacagcaaactgtgtctggaaatggggcttggtcaggaaaagcgccgcgacgacggcattcctggcattactaactatatcttttcagaaactgccgctcgtggaatgtaccaacgctgggccgatcttctgagtagcgaaagctggcaggaagtgctcgataaaaccgccgcttaccagcaggaggtgatgaaatgagtgcgcaagtttcactagagttacatcaccgcattagccagtttctctttcacgaagccagcttactggacgactggaaatttcgtgactggctggcgcagctcgacgaagagattcgttacaccatgcgcaccacagttaacgcgcaaacacgcgaccgccgcaaaggcgtccagccaccgacaacctggatttttaatgacaccaaagaccagctggagcggcgaatcgcccgtctggaaacgggcatggcctgggcagaagagccgccgtcacgcacccgtcacttaatcagcaactgccagataagcgaaaccgacatcccaaacgtatttgctgtgcgggtaaattatctgctttatcgggcacaaaaagagcgcgatgaaacattctatgttggaacgcgtttcgacaaagttcgccgtctggaagatgacaactggcgcttgctggaacgggatatcgtcctggatcaagcggtaatcacttcccataacctgagtgtactgttctgatgaatcgaatttatgcgtgtcccgttgcggatgtgccggagggtgaggctctccggatcgatacctcgcccgtcatcgccctgttcaacgttggcggcgagttttatgccattaacgatcgttgcagccatggtaatgcgtcaatgtcagaagggtatctggaagatgacgccacggtggagtgcccgctacacgccgccagtttttgcctgaaaacggggaaagcgttatgcctgcccgccaccgatccgctcaccacttatccagtacacgttgaaggtggtgacattttcatcgacttaccggaggcgcagccatgagcgatctgcataacgagtccatttttattaccggcggcggatcgggattagggctggcgctggtcgagcgatttatcgaagaaggcgcgcaggttgccacgctggaactgtcggcggcaaaagtcgccagtctgcgtcagcgatttggcgaacatattctggcggtggaaggtaacgtgacctgttatgccgattatcaacgcgcggtcgatcagatcctgactcgttccggcaagctggattgttttatcggcaatgcaggcatctgggatcacaatgcctcactggttaatactcccgcagagacgctcgaaaccggcttccacgagctgtttaacgtcaatgttctcggttacctgctgggcgcaaaagcctgcgctccggcgttaatcgccagtgaaggcagcatgattttcacactgtcaaatgccgcctggtatcctggcggcggtggcccgctgtacaccgccagtaaacatgccgcaaccggacttattcgccaactggcttatgaactggcaccgaaagtgcgggtgaatggcgtcggcccgtgtggtatggccagcgacctgcgcggcccacaggcgctcgggcaaagtgaaacctcgataatgcagtctctgacgccggagaaaattgccgccattttaccgctgcaatttttcccgcaaccggcggattttacggggccgtatgtgatgttgacatcgcggcgcaataatcgcgcattaagcggtgtgatgatcaacgctgatgcgggtttagcgattcgcggcattcgccacgtagcggctgggctggatctttaaggaagcacgatgaaagaaaaaacgatcattattgtcggtggcgggcaagcggcggcaatggctgcggcctcgctacgccagcaagggttcaccggtgagctgcatctgttttccgatgagcgacatcttccttatgaacgacctccactctcgaaatccatgttgctggaagattccccgcagttacagcaggtgttacccgctaactggtggcaggaaaacaatgttcatctgcattccggtgtaaccatcaaaacgctgggtcgcgacacacgagagttagtgttaaccaacggcgaaagctggcactgggatcagctttttatagcaaccggcgcggcagctcgaccgctgccgttgcttgatgcactgggagaacgctgctttaccctacgccatgccggtgatgccgccagactgcgagaagttctgcagcccgaacggtcagtcgtgattatcggtgccggaactattggtctggaactggctgccagcgccacgcagcgcagatgtaaggtgacagtgattgaactggcggcaaccgtcatgggccgtaatgcaccaccgcccgtgcaacgctatcttttacagcgccaccagcaggctggtgtgcgcattctgctcaataatgccattgaacatgtggtcgatggtgaaaaagtagaactgacgctgcaaagtggggaaacgcttcaggctgatgtggtgatttacggtattggtatcagcgccaacgagcaactggctcgcgaggccaaccttgatactgccaatggcattgtcattgatgaggcttgccgcacctgcgatcccgcgatctttgccggtggcgatgtggcaatcactcgtcttgataatggtgcactacaccgctgcgaaagctgggaaaacgccaataaccaggcgcaaattgccgctgccgcaatgttagggctaccgctaccgctactgccgccgccgtggttctggagcgatcagtacagtgataacttacagtttattggcgatatgcgtggcgatgactggctttgtcgtggcaacccggaaactcagaaggcgatttggtttaatctgcaaaacggcgtgcttatcggtgcggtcacgctgaatcaggggcgtgagattcgcccaattcgcaaatggatccagagcggcaaaacgtttgatgcgaaactgctgatagatgagaacatcgcgcttaaatcactgtaaccaggataattagcgaatatctcaatgcctggggcgtggcgaggtgcaagagtgtgtattacgtttaaatcacattatcttgcaaagggattggttatgaacacactacgttattttgattttggagctgcccgccccgttttgttattaattgcccgtatcgccgtggtcttaattttcattatttttggttttcccaaaatgatgggctttgacggtacggtccaatatatggcctcgttgggcgcgccaatgccgatgctggcagcgattattgcggtagttatggaagtgcccgccgcgatattaatcgtgcttggctttttcacccgtccgctggcggtgctgtttattttctacacgctgggtacggcggtgattggtcaccattactgggatatgaccggcgatgcggttgggccaaatatgattaatttctggaagaatgtcagtatcgctggcgcgttcttgctattggcaattaccgggccgggggcaatttctctcgatcggcgttaggaaagatgccggatgcggcgtgaacgccttatccggcatttaataaattacagccactctacccgcaacgacatctctgaagttgttgattcccctggtgctagcgcaatgagatcacccccttccgggcgatgatgatcatccggcgcatggctcatcggttccagacagaagaaatcaaacgcatatcctttatcaaacgcagggtcggaaacaaagatgaaataacacggtgcaggtggcgtcgtttccatgatgatggcataaccttcctgcggctgctcgatgcgggcctgaccattccatccggcaaaaccattgttcacccactggcgcggcaacggcgcgggctggttaaaatccagttcctgcggtagctgctcgcaaaactcacccgccagccactgctcccgctccagccagtaaccgctcgcctgtgcctgaatccgcgtttgcggcgacaacggaaaataaggatgccagccggtaccaaatggcagcgtctctgccccttgattggtgacagagagcgtcaccgtcagcgtatccgccgttaaatgaaacgcctgacttacccgatagtgatagacaccgctgcgatgttcatacaccagacacaaactatcatcgctgtgcgagacacattgccactcgcccagccagccatcgccgtgtagatagtgcgcatcccactcaacattcggttgcagttgatactcacgcccctgccagacaaaacgattgccgctcacccggtttgcaaatggcaccagcggaaaacatgaggcatcggttgccacaccgctttttttaccaggacgtaagagcggcgtcgtatcgcgccagaagccttcgattacgccgccctggtcagaaacgtccagctttagcgacccgtgggataaggtatagatggtcatccgctaactccttaatccgggaagttaatcacaactttcccgcatttgccgctcgccatcagcgcataggcatcacctgcctgttccagcgagaagcgatgggtaatggcgttacgcggccacagcttccagtccgtcagatcatgggcgcatttttccatatggaacagactggtcacccaggagccgataatccgccgttgatggtgcatcagatcggcgctgacctcgaattccacttttccggtttcaccaatgtaaaccacccgtccccagtcagcggtggattgcagtgccagcaagcgacctgcggcattaccggaacaatcgagcgcaacatccgcgccaccgtgggtgagttcggcgataatctgcggcagaccttcggtggttgctaaatagccgtgatccatcacccctaactgttttgccatcgccagacgttccggcagcatatcaacgccgatgatccgttttgcaccgcgacctttcgccagcatcatcgccatcatgccgactggccccagaccgaccaccagcacgttatcactgccggaaacttcgccgcgcaaaattccttcatacgctgtaccaacgccgcaactgataaacgcaccatcttcgtagctcagcgcatccggcaggaggatcagatctttttcttccgccagcaagtattcggcatgaccgccgtcacgctgccagccgtaagccgcttttccttcgccagtacaagaaataggaaaaccgcgacggcagttcgggcaaaaaccacagccagaaatgtgatacaccagcacgcggtcgccctctttaaaatggcggcagccttgccccatcgccacaatctgcccgcacggttcatgaccgttgataaagccctggtataacggtttatcgggtgccgccgctgtggcacggtgttgatgatagatatagtggacatcgcttccgcaaatcccggaggatttcattttgatcagtacctggttaatccccggcgtcggcaccgcaacttcccgcagatcgacggtcgaatttcctggtaaataagctgccagcatcgttttcataaatccctcattaacaatacgattaattttcatccctgccgcacccgcgccaggggcgttaaggtttagcgtttcgctttactgcttcgctgggtcagcaagatattcgccagcaccgccaccacgatgatgacgccgcgtaccacctgctggaaaaaggagttaataccgagcagcaccagaccgttaccgattagcgtaatcaccagcacaccaagcaatgtaccgaacagggaaccgcgaccgccggaaagtgccgtaccgccgaccacgaccgcggcgatgacgtcaaactccagaccgtttgcggcacctgcgttaccagaaccgaggcgcgccgccaacaaaatgccggtcaccgccgctaataatcccgaaagggtaaagataagaatgcgcacccgacgaacgttgatgccgcacaactgcgccgccgtagcattaccgccaacggcaaaaaccgagcgcccgaaggcggttttgcggctgatgaacacaaacagcgcaaacaacacaatcatgatcagcgcggataccggcacaccgagaaattgtccgcccagccagtccagcacctcgttttcatcaatcggcactggcagtgcgttcgtcataaacagccccattccgcgcagggcgctccacagccccagtgtggcaacgaaacttggtacattaaacacgccgcgcagcaccccggccagcgttcccatcagcgcgcctaacagcaacaccagcaggcacgccaccgccagcggaacttcaaattgcagcaaaaatgccaggcacaccgagacaaaagccaccatcggcccaacgctgacatcaatttcaccggagataataatcagcgtcatcgcccaggcggcaatcccaatggtggcggcatcgcgcagcacgttcatctggttattcaatgagataaagccaggcgcgttcagggagaagaccagataaagaatggcaatcaccaccagcaaaccgatctcattaatatggcgactgacaaattgtttgagcgagacgctcttgccctgcggcaatggtaatgacgaagcagacatcttcaggttcctcggtaaaattcatcagtgcacagacagaatggcggacatcagctcatccacattgaccggagcgtgaaactcctgcgagaacgtgccgtgctgtaataacaggatgcggtcacacaccagcggcaactcctccacttcactggagataaacaccacgctttttccttcggcagccagctcacggacaatacggtaaatctgctgtttggcttcgatatcgacgccgcgcgttggctcgtcgagcaacaaaatctggctggcagcatagacccaacgaccgatcaccactttttgctgattgccaccagaaagcgtgccgatgggtgtttcgctactggcggccttgaccgtcatccgctgcatcacctcttcggtcaggcggcggatggtggaccattgcagcacaccgttggcgctgattttttgccgattggtcagcactgtattttcgtcaacgcccaaccagggaatgatccccgcttctttgcggttttctggcgtatagccaatgccgcgtttcagcatgtcgccgtaatcggggcgcgtgattttctcgccgttgataacaatttcgccctgttcatactcctccagcccaacaatcgccttcagcaattcactgcgccctgcccccagcagaccagcaatgccgagcacttcgccacgacgtagcgtaaaactgatatcctccagcttgggcttatggcgtaacgcacggacttccagcacggcctgatccacaatttcctgaggggctaccggcgcaatatcaacgtgatcgcgcccgagcatcagcgacacaatatgatgcgtggaggtgttttcgagcatcacatcgcccgccacctgaccatcgcgcataacggtggcacaggaggcaatgcggcgaatttcttccatccggtggctgacataaatcaccgccacgcccagtgccgacatctttttcaccgcgctgatcaccagttcaacttccgcactcgcaagcgaactggtaggttcatcaagaatgaccacgcgcggctcgcccttcatcacccgcgcaatttccaccagctgcttttgcgccgggcttagcgttgaaacaagttgttcaggactaacgtcaacgcccagcgcctgtaagcaacgttgggcatcctgcgccatttgcaggtaatcaatcatgccgttgcggcggggccactgaccgaggcagaggttttccgccactgtcagcccttccaccagacttaactcctgataaaccgcgcgcacccccagttcagcggcacggcgagtcagcgtagcttcgtcaccttccagtcgcgtctcgccaatccagatatcaccgctatccgggcgttcgctgccggtaagcattcgaatgagagtcgatttgcccgcgccgtttttacctaacagcgcacgaacttcgcctttattgagcgtgaagttaacgttatccagcgcaacgacgccgggataacgcttatttcctgccaccacttttgctaccgggactgcctctgttgccgtgaacatagggacctctgcgaatcagcgattagggcagaccatcaacgtgcgttgccagccactgtttaccgtcttccgttttggtatagagatcgataggcacctgaatcactttttcaccgtcggcttgtttattgataaccttcaatgtttgcgcgaaaacagcattgcccattttcttaccggaaatatccactaccgctttcagcacctgattgttttccagctcctgagcaatttcggttgtcatatccgaaccgaaaacagcaatttttccggcctgattttgattacgtaccgcttttaccgcgccgagtgtcgcaccgcccgattcccccataatggcgttgagatccggcgtggagataattagtttttcaccaacggaaatcgctttatctaaaacagtcccttcctgattagcgacaatttgcgcgccgggaacgcgggattttaaaacttcttcaaatcctttacgtcgctgcacacaaacttcaaaggcttcgcaattgatgacggcaattttcggctggtcaattttattggcaataaaataatcagcggcagcgttacccagttttttaccaaattccagcggatcgccgaccagatacgccgagacatatttatcgacccccttttgattaatacaggtgttgtagcaaatcaccggaatgcccgcttcactggcgcgacgaacggtacggctactgccattttcagacactgccgataaaataatggcatcgacattacgcgccacgagggtatcaacaaaggtactttctttcgaaatatcaccctgggcgttagtttctattaactgaacttgtactgaggaatcttttgccgcatcctgaacgccctgacgcactccagcgtagtatccctgagtatcaaggtatattgcgccaatggtcatttctttttccgcagccctggcaaatagtgcgctacctaatagcgtagccattaataatagattacgggttgttctcatttttgtaggcatagagcctcctgtagggtttttattaacaacggcttattctaattattttgtgatgagcggcagcgcgtgccgctcaaatattacagttaatagggtttagtgaacgcggttaaaaataaaaggcatcacggtggtgaataatgccgctttcggccaagccggattaatcgccgtcaattcagcgcgagcagactcatattgcgcaacctccccgagtcccgcggacgccagcatcgccaccatcaggcatttttctttatgctgctgttgtaaatcgccatacagcgacaacaagtcaggttgcgagacggcaaagaaatccgcttcgatactggttttcgccatctcttgcgcccactgtttcatttcactaaacagttgctgtgcggtttgttgttcgcccagcagtcgcagcgccatcccttgccagaagagataatcaaccggctgatcgttgtaataactgtgaatgttaatagtgcgatcgccggtcgccgccagacgtaaacaacgcgtcgcttcagtttcatcgccctgcgcgttggcgcatatcgcctgccagaaccagatgtcgttatcagtttgccccggtaaacggccttcgcttaaattctccggataatgcagcgcggcatgaagcagttcgcaggcctgctgcggctgtctggcatcaagatgctgccaggcgcgtaataactggttgaggataaactgactggtgaccttcccttccccgccttcccacgggtggaatttgcgcgtggcgagaatgtccgccgctttgtctgcctgacccgtgagatgccacaaattgagcagttctgcggtcatgtcgtcgcgtttcagcgcaatttccagattattttccagacgcgccagtcgtttctccggtgtggctccacttaacttatccagcaaatcccgttcgaaaagcagacgtgcatcctgcggcgcaagctgataagcattatcaagataacgcgcggccagctcataatcgtgttgcttattccacgcatggatcgctaacccgcgccagccgtcggcaaactccggcgacatctctacgcaacgttgccaaaaggcaatggctttgttgtagctacgtttgttgtagtagaagcaagctagtaaatggcgagcaaaccagcactcttcaatactctccagcgccgccacttcttccagcgtattcgggaaacggacaaactgcgggaagacatcaatggcttttgcgaccagttcgccacgttcggctttcggcagcaagctggcttgcaggtaaagcggcagcgtgcgctggcagtccagtgcgttcagcatctctgccgccagggtgggcattccccagttaatcagttgcccggcggtcatcagggcgttaacgtcgcgtccctgacacagaccgcgccactgcgcgagagctgattcgctacgaccatcgaaccagttcagccaccacagagtggcgttcagcggataatcgcgcagcagtttctcgcgctgcacacgcgcgttgtcctgacgaccacttaacaccagcagcagattatgcaggcaaagcacttcctgattggttgggcaggcgcgaagactttgttggcaaaaatccagaccagcgtcgaagttaccattacgcgccgccagtcgtgccaggccataatagccaccggctttgctgttgccgctccagaccgcacgccagaaatcctcttcggcttgttgatattgtccctgacgttcgtaagcactggcgcgaatcaaactcgcctgtccgcactgcggatttttgttcagcgcatgtgcgcgtttcagagcctgagtggcatacgccaccgcttgcgggaaatctgcgcggttatattccagcatcgccagcgccaggttacagcgataatccagcgggtccagcgccacgccgcgcaggtagtaatcgaacggtgaacggctggcgtgatgatattgctccagatgctgaccgataaaccaggcttcatctgtactggtaatgtcttgtgctgccagtggcgctttggcgacgtccggtaacggcaacgcttgcggctgatgttcctgataactcagtacaatattgccgtcggcatcggagagctcaatggtcagcctttcaggattgataccgtgcaacacgccctggatggcggtcgcaggcatcagtgccacggcatcatcaagtaacgcgttgcatttaccgatttcgcggatcgccaggcggtatccgttcaacggagagatggcatacagcccccactcaatcccccgcttactacgctggagttttatcaccgcatcgcgggaggcattttgcaccatgcccaaagaatgataaggcaggaaatactgctcaaaacgcttctcttcgtaagcatcaagccaggtaaaatcgggctggttatcggcaaaaataccggtcatcagttcgatatacgggccgttattgtcggtcagactcttatcccacgcctggccaaattcactgtgtccccaactccactgttttttacctggcgcaatatggtggttggcaacgtgcagcaaaccgccatcttcatcgtgacaccacgcgccgacaaaatcgtactgcgatttttcggccatatatgaggttggaacaggcacatttttatagcgagaaatgtccactccagcggagtagtccactttgtagtaagtgccggtagcgatggggaaagcggagacggcccgtttgccgtgatcaaacaccgccgttacatccggcgggaagacgctctgatgcccttccccccctttcactgccgggttggcccaccacaagaaatgacgcggcgtggcgttcccgttatagacgcggctggcgatttccagcgccgcccggtcagggcgcagggtgaaacctgtcatcacctgtaaaccatgcatcggctccgtttcgcctacccacaccgtctgtgcaccgtcttcatgggcttcgagggtgaaatcaacgggcataaaggtggtcgggcgatgatgttgcggccagttaaactcaatcccaccggaaatccacggccccagcagccccaccagcgcaggtttaatgacttcattgtgataaacaaaatcgcgctgtttcactttatcccacgcgcgatgcacccgaccgcccagttccggcaggatcatcactttgatgtagtcgttttccagccacaccgcctgccaggatttcagggttttctgctcgctcagcgtatcggtcacgccgtagggataaaccgcgccggacgatccctgataaacgcgattttccaggaacatgggatgtatatcctgcggcccggtttcataggtcgggatctcaacgcgctcttgccacacttttactggagtcatggtgccctcaatattaacaagacatactgaattaaaagatttgtggcagtgtattgaacaatctggcaatgttttcgcggaataatcacgcaattaactaaacaaggtttagtgaagatgagagcctgcattaataatcaacagattcgccaccataacaaatgcgtgattctggaactgctgtaccggcaaaagcgcgccaataaatcaacgctggcccggctggcgcaaatttcgattccggcagtcagtaatattttgcaggaactggaaagcgaaaaacgggtggtgaatattgacgatgaaagccagacgcgcgggcatagtagcggtacatggctgattgcgccggaaggtgactggacgctgtgcctgaacgtgacgcccaccagtattgagtgtcaggttgctaatgcttgtttaagtccgaaaggtgaatttgagtatttacagattgatgcaccgacgccgcaggcgctgctgtccgaaatcgaaaaatgctggcatcgccaccgtaaattgtggccggaccataccatcaacctggcgttggcaatccacggtcaggttgatcctgtgaccggcgtgtcgcaaaccatgccgcaagcgccgtggacaacgccggtggaggtgaaatatctgctggaagagaagctcggcattcgggtgatggtcgataatgactgcgtgatgctggcgctggcggagaaatggcaaaataattcgcaggaacgggatttctgcgtgatcaacgttgattacggcattggctcgtcgttcgtgattaacgagcaaatttatcgcggcagtttgtatggtagcggacagattggtcacaccatcgttaatccggatggcgtcgtctgcgactgtggacgttatggctgcctggaaactgtcgcctcgttaagcgcattaaaaaaacaggcgcgggtatggctaaaatcacaaccggttagtactcaacttgatcctgaaaaactgactacagcgcagttaatcgctgcctggcaaagtggagaaccgtggatcaccagctgggttgatcgctctgccaatgccattggtttgagtctgtataacttcctcaacatcctcaatattaatcagatttggttgtacggtcgcagttgtgcctttggtgagaactggcttaatactattattcgccagacaggatttaacccgttcgaccgcgacgaaggaccgagcgtgaaagcgacgcaaattggctttgggcaattaagccgcgcacaacaggtgctgggaattggctatttgtatgttgaggcgcagttacgacagatttgatggcgcgataacgtagaaaggcttcccgaaggaagccttgatgatcataaacgaaaaattgcctgatgcgctacgcttatcaggcctacacggagattgcaatatattgaatttgcaaagttttgtaggccggataaggcgttcacgccgcatccggcatgaacaacgagcacattgacagcaaatcaccgtttcgcttatgcgtaaaccgggtaacgtgcgcagatgtcgagaactttacctttgatgcgctcgataacggcttcatcattgatgctgtccagcacgtcacacatccagccagccagttctttcgcttcggcttctttaaagccgcgacgggtaatcgccggagtacctacacgaataccggaggtcacaaacgggctcttcggatcgttcggtacgctgtttttgttgacggtgatgttagcacggcccagagcggcgtctgcttctttaccggtcaggtttttatcaaccagatcaaccaggaacaggtggttatcagtgccgccggaaaccactttgtagccgcgctcgaggaacacttctaccatcgctttagcgtttttagcgacctgctgctggtaagttttgaactcaggctccatcgcttctttcagagcaaccgctttaccggcgattacgtgcatcaacggaccgccctgaccaccagggaaaacggcagagttcagttttttgtacagctcttcgctaccacctttcgccaggatcaggccgccgcgcggacccgccagggttttgtgagtggtggtagtaacaacgtgagcatgaggaaccgggttcgggtagacgccagcagcaaccaggcccgcaacgtgcgccatatcaacgaacaggtaagcaccgatgctgtcagcgatttcacgcattttcgcccagtccaccacgccggaatatgcagagaaaccaccgataatcattttcggcttgtgttctttggcttgtttttccagatcggcgtagtcgatatgaccggtagcatcgataccgtaaggaacgatgttgtacagtttaccggagaagttaaccggagaaccgtgagtcaggtgaccgccatgcgccaggttcatacccagaacggtatcacctggttccagcagcgcggtgtagaccgcaaagttagcctgggagccggagtgcggctggacgttagcgtagtcagcgccgaacagttctttcgcacgatcgatcgccagttgttcaacgatatcaacatactcgcaaccgccgtagtagcgtttgcccggataaccttcagcatatttgttggtcagctgagaaccctgcgcctgcattacgcgcgggctggtgtagttttcggaggcgatcagttcgatgtgctcttcctgacgtactttttcctgctccatagcctgccacagttcggcatcataatcggcaatgttcatttcacgctttaacatccgcatctcctgactcagctaacaataaaatttttggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaggaagaccatatgcttgacgctcaaaccatcgctacagtaaaagccaccatccctttactggtggaaacggggccaaagttaaccgcccatttctacgaccgtatgtttactcataacccagaactcaaagaaatttttaacatgagtaaccagcgtaatggcgatcaacgtgaagccctgtttaacgctattgccgcctacgccagtaatattgaaaacctgcctgcgctgctgccagcggtagaaaaaatcgcgcagaagcacaccagcttccagatcaaaccggaacagtacaacatcgtcggtgaacacctgttggcaacgctggacgaaatgttcagcccggggcaggaagtgctggacgcgtggggtaaagcctatggtgtactggctaatgtatttatcaatcgcgaggcggaaatctataacgaaaacgccagcaaagccggtggttgggaaggtactcgcgatttccgcattgtggctaaaacaccgcgcagcgcgcttatcaccagcttcgaactggagccggtcgacggtggcgcagtggcagaataccgtccggggcaatatctcggcgtctggctgaagccggaaggtttcccacatcaggaaattcgtcagtactctttgactcgcaaaccggatggcaaaggctatcgtattgcggtgaaacgcgaagagggtgggcaggtatccaactggttgcacaatcacgccaatgttggcgatgtcgtgaaactggtcgctccggcaggtgatttctttatggctgtcgcagatgacacaccagtgacgttaatctctgccggtgttggtcaaacgccaatgctggcaatgctcgacacgctggcaaaagcaggccacacagcacaagtgaactggttccatgcggcagaaaatggcgatgttcacgcctttgccgatgaagttaaggaactggggcagtcactgccgcgctttaccgcgcacacctggtatcgtcagccgagcgaagccgatcgcgctaaaggtcagtttgatagcgaaggtctgatggatttgagcaaactggaaggtgcgttcagcgatccgacaatgcagttctatctctgcggcccggttggcttcatgcagtttaccgcgaaacagttagtggatctgggcgtgaagcaggaaaacattcattacgaatgctttggcccgcataaggtgctgtaatttgatgttgccggatggaaacatccggcaacccttgacgcggtttaaattgccgcgtcgtcctcttcaccggtacggatgcgaatgacccgtgccacgtcaaagacgaagattttaccgtcaccgattttgccggtttgcgccgtgcgaataatggtatcgacacaggtatcgacaatgtcgtccggtacgacaatctcaattttcactttcggcagaaaatccaccatatactccgcgccgcggtacagctcggtatggcctttctggcgaccaaagcctttcacttcggtcaccgtcatgccggtaataccgacttcggccagtgcttcgcggacatcgtccagcttgaagggttttataatcgcatcaatctttttcatgctattccttgaaaaggtcgcctgtcttttgatctgctaaacgtaacacataacgccaattcattccttgaaatcgtttgcatccagctcgtgtcgggaaagcagtttataaaattctgtccggttgcgccccgccattctcgccgcgtgggtgacgttgcctttggtgatttgcagcagcttacgcaaatagttgagttcaaactgattacgtgcctcaacaaaggttggcagcgccgtattttcaccctccagcgcctgctccaccagcgcatcactaatcaccggagatgaggtcagcgccacgcactgttcaatcacgttgaccaactggcgcacattacccggccagctcgcggtcatcaggcgtttcatcgcatcggtagagaacgcgcggacaaacggtttatgtcgctctgccgcctggcgcaacaggtgatttgccagtagcggaatgtcttctgtgcgctccgccagtgccggaattttcaggctgacaacgttgaggcggtaatagagatcttcgcggaattccccgcgcgccatcgcttttggcagatcacggtgagtggcagaaataatccgcacattgatatcaatatcgcggttactgcccagcgggcgcactttacgctcctgcaacacgcgcagcagtttgacctgtaacggcgcaggcatatcgccaatttcatcgagaaatagcgttccgccttccgccgcctggaataaaccttcgcgattgctgacagcgccagtaaacgcgccacgcgcatgaccaaacagctccgactccagcaattgctcgggcaatgcgccacagttaatagcaataaatggtttgctgttgcgcgggctggcgttgtggatagcctgggcgaaaatctctttcccggtgccgctctgaccgttaatcaaaacgctgacgtctgattgcgccaccagccgcgcctgttccagcaaacgcagcatcagcgggctgcgggtgacaattgcctcgcgccagcgttcatcggtggctggcgcggattgctccagcgcatcgtcaattgcctgatatagcgcgtctttgtcgacaggcttggtgaggaaactaaaaacgccctgctgtgttgcagcaacggcatcgggaatagaaccatgcgcggtaagaataattaccggcattcccggctgcactttctggatttcagcaaacagctgcataccgtccatttcatccatccgcaggtcgctgatgactaaatctactttttcgcgattcagtacccgtaatccttcagcgccactttccgccgtgaccacactgtagccttcgctggtcaggcgcaggccaagcagtttcagcaatcccggatcgtcatcgaccaataataaatgcgcaggtttatggctcatcaggagtgacctcatgggtggatggcgcgggcttttcactctcgtgcggcgtatccggcgagaaatttccagccggtttgcgggtcgagagctggcgttcaatatcggtcaggttttccagcttgcgggtggtgagttccagttgctgctgtagaacgtgatgttgctggcgcaatgtatccagctcgctgtcgctggactgctggagtttactgtaacgttggcgctcttccgccagttgcagttgcagcgcctgaccatcgcgccagagttgatacagtgggcgaacctgtgccgggatctcggtacttaacgcttcaatacgcgcgaccagctggcggcgctcatacggcgtaattttggcgtcggcgagcaaaatcccttgtttaaaggtattttgccagctgccgtcgtcatattggcgagcttgctgacgcgactgcgcaggcattaaacgatcagcacaatccatcgcccgcagccagtaaagcggattggtttcggttgatttaccttgcagcgcccagatgtcgctacattcagtagaaagatagtcagccagttgataaaccggaattttttcttctgctggcgtatcaatggctggcttattgtgattctgcacgcaacccagcaatgccagacatggcagccctgccagccacagccgtcggggcaataatcgttgaaaaatgtgtcgcatattcaccagacttaaagcctatcccagtgggcgtaattgttgcagacagtctggacatggacagcgcggagaaaccggagcgtacatatcgtacgtgaagatttcgagcactgcccggggccgaactgacaaataaaatagcctgataggataggctgttagcattatttcgtgtttttcgacgacggtaattcaatgcggaaacaaacgtcttgcccgctctcgtcgaccagatacagttccccttgcatacggcgaatacaatccctggcaatgcttaatcccagaccgctgcccttcaccgccccttttcgctggtggcttccctgaaaaaagggttcgaagatcatggcgcgttcctcttgcggaatgggcgtgcctgtattgatgacatcaatataaacccgcgcaccatgtaaactgctgcgaaggcaaatgttaccggattcagccccgtagtgcaccgcattggagtaaagattatccagtacgctcatcagcagcattggctccgccaggcaagctgttgctttgagatcgacgtcggtatgcatcattttagcccgtgcgggcaggctatgagcagaaaccactgtctccaccagcggtgctaactcaacattctccagttccaccgcactgtccgcctgtttacggttgtaatcaagcagttgttcgatcagtttttgcaaattgcggctgctgctatcaagaatgctcaccacctctttttgctctggcgtaagcggcccgacaacctggtcagccagtaattcagtgccctcgcgcatactcgccagtggcgtttttaattcatgagataaatgtcttaaaaattgatggcgttgggattccagccatgacaggcgctcacttaaccaaagaatacgttgcccaaccgagcgtaactcgctcggtccactgaacgagacgctattgcccagagaacgcccttcccccagacggttgatcatgcgctcgatatttttcaccggcccgataatcatccgcgtgaaaagcagtaccattaccagactcaccagaaatagcaccagcgattgccaaccaaaatattgcccacgttcggcgatttcacgctgaagctgctgcccacgagagaacaccactgtgcgcgtggcctgtaccatttcggtattggcactggcaaaggcttcaagacgtgcggcggcggcagcatcgggaccgctgttgttacactgaagttgagccagattgtgcaaatcctgacgtaatgcctggtagagtttatcgtccggcagcacgcctgcgtgggcatcgagcatttcgctgtaacgcttgcgctggctttgataaaccttcgccagggttgggtcgtccagcacgcaatactgacggtaactacgctccatctccagcgccgcgttggtcatcgcttcactgcgccgggcatcaataagcgtagtgcggttaaccagcgccgcctgatcgctaagcgcattcaggctttgccaggcttgccatgccagcaccaacaggggcagcagaatcagcaaaaatgccagcattaccagttgtcgtaatgagcggggaaaaacgggccagcgtttcaaggtgttactctcgtcagacgcgaatagcctgatgctaaccgaggggaagttcagatacaacaaagccgggaattacccggctttgttatggaataaggcggtgcctaactcgacgtttcgcccgatggttgatatagctacgctgatatcagaagttggacggcaggcaccttgttgtgcgtcattcgtattttatgtagcacgtcccgaaggggctgacataagtcggtgaatgagccactggttactattatgcagtaactgtgccaataaagaaaatagtttggtaacgtactgattatacgttgctttgaggggtttatgtctcctccgctgtttgaatgtaaatcagccactgtgtcgctaaaaagagacaacttaagataaacttattagataatattaaaatcaatgagttaagtgtcgccagaaagcgacacggcaaaccacccattgtcgtgatttacagacacaaaaaagctcccggagttgggagcttatgatagtggttggtgcttaatgccgcatccgggctgcaaaaccaatgggctgacgacttaccccaactgcttacgcgcattgcggaaaatgcgcatccatgggccatcctcgccccagttttccggatgccaggagttgctgacagtacggaaaacacgttccgggtgcggcatcataatggtgactcgaccactttcagtcgtgactgccgtaataccgttcggtgaaccgttcgggttagccgggtaggtttcagtgactttgccgaagttatcgacatagcgcagtgccaccagccctttgctttccagtgccgccagatgcgccgcatcacgcacttccacgcgcccttcaccatgagagacagcaatcggcatttgcgagcccaccatcccctgcaacagcagagacgggctttgggttacttcaaccaggctgaaacgcgcttcaaagcgatcggaggtattgcgcacaaaacgtggccacaactcactacctgggatcagttcacgcagattagacatcatctggcaaccgttacatacccccagcgccagcgtttgcggacggtggaagaaggttgcaaactcatcgcgtacacggtcattgaacaggattgacttcgcccaaccttcaccggcacccagcacatcaccgtaggagaaaccaccgcacgcgaccagggcgtggaaatcttccaggcccgtgcgtccggtcagcaggtcactcatatgcacgtcgatagcatcaaagcctgcacggtggaaagctgccgccatttcaacatgcgagttcacgccctgctcacgcagtacggcaactttcggacgtgcgccagtggcaatatacggtgctgccacatcttcgttgatatcgaacgacagttttacattcaggcccggatcggcgtcgttagatttcgcctgatgctcctgatcggcacactccgggttgtcacgcaggcgctgcatctgccaggtagtttctgcccaccagacacgcaacgtggtgcggctttcgctgaatacagtctgcccgttggcggtaatcacaaaacggtcaccggaaaccgcctgccctacataatggacacaatcagcaagcccatgctgtgccagtacggactcgaccgcttcacggtcagcggcacgaacctgaatcaccgcacccagttcttcgttaaacaacgccgccaggcgatcgtcacccagagtggcgatatccgcgtcaatgccacaatgaccagcaaaggccatttccgccagcgttaccagcaggccgccatcagagcggtcgtgatacgccagcagcttacgctgtgcaaccagcgcctgaatcgcgtcatagaagcctttcagttgcgcgacatcgcgtacatctgccggtttgtcgccaagctgacgataaacctgcgccagcgccgttgcgcccagcgcgttattgcctttgcccaaatcaatcagcagcagtgcgttatcttcggtagaaagctgcggcgtgatggtgtgacgtacatcttccacgcgggcaaatgcagaaatcaccagcgacagcggcgacgtcatttcgcgctcttcgttaccttcctgccagcgggttttcatcgacatggagtctttacccaccgggatcgtcaggcccagcgccggacaaagctcttcgcccacggctttaacggcttcatacaggcccgcatcttcaccagggtggcctgccgccgccatccagttggcggaaagtttgatgcgtttgatatcgccaatttgtgttgcggcgatgttggttaacgcttcaccgaccgccagacgggcagaggcggcgaaatccagcagcgcaaccggcgcacgctcgccaatcgccatcgcttcaccgtagtagctgtcgaggctggcggtagtgaccgcgcagttagcgaccggcacctgccacggccccaccatctgatcgcgcgctaccatgccggttacgctgcggtcgccaatggtcaccaggaaggttttttccgccacagtcggcagatgcagcacacgtttcaccgcgtctgcaatggtgatcccttcacgggccagcgcgtcgcctttcgctttcagcgtttgtacatcgcgggtcatcttcggcgttttaccaagcaggacgtccagcggcagatcgatcggctgattatcaaaatgacgatcgtgcagagaaagatgcagttcttcggtcgcttcaccaatcaccgcgtagggtgcgcgctcacgcttacacagttcgtcaaacagcggtaattgatcggcagcaaccgccagcacgtagcgttcctgggattcgttacaccagatttccagcgggctcatgcccggttcgtcgcttagaatctcgcgcagttcaaatttaccgccgcgcccgccgtcgctcaccagttccggcatggcgttagaaagaccgccagcgccaacgtcgtggataaacaggattgggttggcatcaccaagctgccagcaacggtcgatcacttcctggcagcgacgctccatctccgggttgtcgcgctgtacggaagcaaagtcgaggtcggcatcagactgaccagacgccatagaagacgctgcaccaccgccaagaccgatgttcattgccgggccgccgagaacgaccagcttcgcaccgacgttgatctcgcctttttgtacgtgatcggcgcgaatgttgccgatcccgcccgccagcatgatcggtttgtgataaccgcgcagctcttcgccgttgtggctgttcactttttcttcataagtacggaagtagccgttcagtgccggacgaccaaattcgttgttaaacgccgcgccgcccagcgggccttcggtcatgatgtccagcgcggtgacaatgcgctcaggcttaccgaaatcttcttcccacggctgttcgaagccaggaattcgcaggttggaaacggagaaaccaaccagacccgctttcggctttgcgccgcgcccggtggcaccttcatcgcggatttcaccgccggaaccggtcgccgcgcccggccacggagaaatcgccgtcgggtggttgtgagtttcgactttcatcagaatatgcgccggttcctgatggaaatcgtagcggcccgtttcgtggtcagcaaagtagcggcccacttcagaaccttccattacggcggcgttatctttataagcagagagaacgtgatctggcgtggtttcgaaagtatttttgatcatcttgaacagcgatttcggctgctgttcaccatcgataacccagtcggcgttaaaaattttgtggcggcagtgctcggagttcgcctgggcaaacatatacagttcgatgtcgttcgggttacgaccaagctttgtgaaagcatcctgcagatagtcaatttcatcttccgccagagccaagccaagacgcaggttagcgtcgatcagcgcctgacggccctgccccagcaaatcaacgctggtaaccggagtcggttgatggtgggcaaacaactgctctgcatcatctaaagcaaaaaagaccgtttccatcatgcggtcgtgcagttcagcggtaacctgctgccattgttcattggtcagcgtaccggcttctatatagtaagcaacgccgcgctcaaggcggtttacctgttgtagcccgcagttatgggcaatatcggtcgctttcgaagaccagggagagatggtgccaggacgcggggtcaccagcaggagtttgccttgcggggcgtggctggcgagtgccgggccatatttcagcaggcgttcaagttgtgcgtgctcatcatcgtttaacggcgcattgaggtcagcaaaatggacatactcggcgtaaatattgtgaaccgggagcctggcagcctgaaaacgtgccagcagtttgttgattcggaatgccgacagtgcaggcgaaccacgcagaatttccatcataagtctctcgtcttctaagctttcggtgtacccaagggggggaaacgggcgtcattataaagaatctgatgcgctgacgaaaccgtttgcgtggaaataaaatcaccatcgtgaattagcaacgcgtgccgccaatggctgtaataagttgccatctggcgcaggtttacgcaaaatgccgctcatttatgagtaaacctttcactattattacgttttttcaagctgggacgcgcacgacacagagaattaactaattgaaaaaattaaagattaattatctgttcatcggcattctggcactgctgctcgcggtcgctctctggccatccattccctggtttggtaaagccgacaaccgtatcgccgccattcaagcgcggggagagttgcgtgtgagcaccattcatactcccctgacttataacgaaatcaacgggaaaccttttggcctggattacgaactggcgaaacagtttgccgattacctcggcgtaaaactgaaagtgaccgtgcggcagaatatcagccagctgtttgacgaccttgataatggtaacgccgacctgctggcggcaggacttgtctataacagtgagcgggtaaaaaattatcagcctggccctacctattattccgtgtcacaacaactggtttataaagtgggtcagtatcgcccacgtacgctgggcaacctgacggcggagcaactcaccgttgcaccgggtcatgtggtggttaacgatctccagaccctgaaagaaacaaaattcccggaattaagctggaaggtagacgacaaaaaaggctctgcggaattaatggaagatgtcatcgaaggaaaactcgattacaccattgctgattctgtcgccatcagcctgtttcagcgcgttcacccggagctcgccgtagcgctcgatatcaccgatgaacaaccggtgacttggtttagcccgttagatggcgataataccctttccgccgccctgctcgacttcttcaacgaaatgaatgaagacggtacgctggcacgcattgaagagaaatacctggggcatggcgatgattttgattacgtcgatacgcgcacatttttacgcgccgtcgatgcggtactgccgcagttaaagcccctgtttgagaaatacgccgaagaaattgactggcgtttgctggccgctattgcttatcaggaatcgcactgggatgcacaggccacttcaccgacgggtgtgcgcggcatgatgatgttaaccaaaaataccgcgcaaagcctcggcattacggatcgtaccgatgccgaacagagcatcagcggtggcgtgcgttatttgcaggatatgatgagtaaagtgccggaaagtgtgccggagaacgagcggatctggtttgccctcgctgcgtacaatatgggctatgcgcatatgctggatgcccgcgccctgacggcaaaaaccaaagggaatcctgacagttgggctgacgtaaaacagcgtctgcctttacttagccagaaaccctattacagcaagctgacttacggctacgctcgtggacatgaagcctacgcttatgtcgaaaatattcgtaagtatcagattagcctggtgggttatctgcaagagaaagagaagcaggctacagaagcggcgatgcaactggcgcaggattatccggcggtatcgcctacggagttgggcaaagagaaatttccttttctctcgtttctttcccagtcgtcatcaaactatttgacccattctccctctctgctgttttccaggaaagggagtgaagagaaacaaaattaatccgtcgaggattgcgcttttttctgcgctttaatttcctggcggcgcatgcgaaagaagtcactgagcaacgccgcgcactcatccgccagtattccttccgtaatttccactcggtgattcatacccggatgatgcagcacatccattaaagatcccgcagcgccagttttcgcgtcacgcgcaccaaagaccacgcgaccaatgcgactgtggatcatcgctccggcacacattacacatggttcaagcgtgacatacaacgtggcgtcgatcagacgataattttgcatcaccagaccaccctgccgcagggccatgatttctgcatgtgcggtgggatcatggcgaccaatcgggcggttccagccttcgccgattacccgattgttatgcactaataccgcgccgaccggcacttcccgctcatcccaggcacgtttcgccagcgtcagcgcgtgacgcatccagtattcgtggctaaattcgacttcagacaaaaagaaaactccggttataaaagcgcggcgcattatacacggacgctatgctttactctattccagttgctggagttcaccgcgcggggttactcgccaacgatgctgacagaaataaagcagcggattgtcctgattactgtcgctatagccactgtacagccgcagcggagtgccgattttgcgctccagttgtgcgaccttttcatgtcccagacaacgcatcgtcaatacccaaccaccatagccacgctgaatttggctggcgataagattaacccgcggcagccagggcgtatcgaaataaaccgcttcaaccagcggctgcggagagccggtaatcaaccagatatcagcatcggaacttaacaggtaggtggttaatcgctcctgaaccagcggaaaggcggtaacattgtcgcgaaaccagcgcacgaaatcggcctgcaacgtctgtaaacgtgcttcgctgtgaccaaaagtgcacccccacagaagcagactcatcggccagcgtgccgcacgaccttttatcaataacgcaatggctataatcggtaacaacggcaggacaagtaacgcattcagcggttggcgacgtagtaaatagcgcagaaaactgccgaacatatcctgctgatgcaatgttccatctaagtcaaaaaacaccacacgacgctcgtgagttgccaaaccatactcctctggactgaaacatcctgattaattttcgctactacatagcctaacagatagatcatcacttttccggcaacaatcgaccgcatcatggctaactggaatttttaattcatggcaattagcggcaatggaatataaaattcactcgcgtgtgtctcatattgcctgttgtcgccactatttcatcgcgaggaaagatatgaacggcttacttcgtatccgtcagcgttaccaggggcttgcccagagtgataaaaaactggcggattatctgctgctacaacctgatacggcgcgccatttaagctctcagcaactggccaacgaagccggagtcagtcagtccagcgtcgtgaagttcgcgcaaaaactcggctataaaggttttccggcgcttaagttggcgttgagtgaagcgctggcaagccagccggaatcaccctccgtgcccattcataaccaaatccgcggtgatgatccgttacggctggtcggcgaaaaactgattaaagaaaatactgccgctatgtacgcaacgctaaacgttaatagtgaagagaaactgcatgaatgcgtaacaatgttgcgctctgcgcggcggataattctgaccggtattggcgcttcgggtctggtggcgcaaaactttgcctggaagctgatgaagattggcttcaatgctgccgcagtgcgcgatatgcatgcgctactcgcaacagtacaggcgtcgtcccctgacgatctgttattagccatttcctacaccggtgtacgacgcgagttaaacctggcggcagatgagatgctgcgagtgggcggaaaagtgctggcgattaccggctttactccgaatgccctgcaacagcgtgcttctcattgcctgtataccattgccgaagaacaagcgacaaacagtgcttcaatctctgcttgtcacgctcagggaatgttaacggatttgctgttcattgcgctgattcagcaggatctggaactggcaccagaacgtattcgtcatagtgaagcgctggtgaaaaaactggtctgagtaaagaatgcgcgtataatgcccgcccggtttgtgttgttttgagagtttccttatggcgttgttaatcactaaaaaatgcatcaattgtgatatgtgtgaacccgaatgcccgaatgaggcgatttcaatgggagatcatatctacgagattaacagcgataagtgtaccgaatgcgtagggcactacgagacaccaacctgccagaaggtgtgcccgatccccaatactattgtgaaagatccggcgcatgtcgagacagaagaacagttgtgggataaatttgtgctgatgcaccacgcggataaaatttaatattctactctggaagtagagtattaattatattactgggaagccttaacgccattatatttatttaattgatgacattagcataatcattcactaagttaatttatatagtatctgcccagacacttatttatagttattaaaggtgcgtccgactggttcaccggacgcaccttaagtacgtttccttgtgttataagaacagaaggatcagctgtaaaacagcaatgatgattttgatgacccgtttaatcaggtatcggcaatcagtcattcgtttttccttaaacaaggaatgcagccattcagattagcccttacatctccccaaaactgaacgtgcgagttattgagggtgcatgctgcactccacaccagagctttgacgacaccactcgtttcaatgggggaattctgtggcatggtgtaaagcacagcaaaatcttcaataacgaagccaattttaatgtacttacgaattggcggtcacgttaatctttccatcaatattgctttcttcgtaaaggctcgagtttttatgctaaagattgcaagttgcttgtaaaagataagtacactgatccataatcgctgttgttgagggtgcatgctgcacaaaattaaagttaaaaagtaaaacccccgttccttaccagttcgggggttttactttttaaagagaacggtattatttttaactttcaataattaccgtggcacaagcatagtgccgctcatctgccagcgttacatgcatatttgcaacgcccagcttttccgccagttttaatgcctcgccccatagccgtagccgtggtttgccgagctcatcattgaatacttcaaattgattaaacgccagaccattgcggatcccggtgccaaacgcttttgctgcggcttctttcacagcaaaacgcttcgccagaaaacgcaccggctggtggtgcgttttccagatagcccattcgttatcgcttaatacgcggcgtgccaggcgatcaccggatcgggcgatcaccgcttcgatgcgagcgatctccacaatatccgtgcctaaacctaatattgccattagccacgcgcttccagcatcagacgcttcatttctgccaccgcatctttcagtccggtcatcactgcacgaccaataatggcatgaccgatattcagttcatgcatctcagggatggcggcaatggctttcacgttgtgataggtcagaccgtgtccggcgttaactttcagaccgaggcttgcggcaaaggtcgcggctttggcgatacgcgccagctcttgcgcctgttcggcgtcagttttggcatcagcatagcaaccggtgtggatctcgataaacggtgcgccaacctctgccgcagctttgatctgctcttcatcggcgtcaataaacagagaaacctgaatcccggcatctgccagacgtttgcaggcatcgcgcattttgtcacgctgccctgcgacatccaggccgccttcggttgttacttcctgacgcttttccggtaccaggcagcaaaaatgtggcttcgtctcaacggcgatcgccagcatctcttcggtcaccgccatctccagattcatgcgggtatccagcgtctgacgcaggatgcgcacgtcgcggtcagtaatgtgacggcgatcttcacgtaaatgcacggtaatgccgtccgctcccgcctgctcggcaataaacgcggcctgcaccggatccgggtaagcggtaccgcgcgcgttgcgcagcgtagcgatatggtcaatgttgacgcctaacagtaattcagccatgacaatcctcatcattcataatgtgttttcaccgttcgcttaggcataaactgccggaacagttccctgctctttaaaggtttaccgccaagatacggcttaagcgccatgcgggtaaagcgtttcgcggcgcgcagtgtgtctgcgtcaggaaattcccgtgcgtttaacgcttttaactgccttccggtgaacgttttattgtcgataacgacgcttgcgataaaccctttttcttcgcgataacgatacgtcatggtgtcatctaccggctcgccgctacccgcacaatgggtaaaattgacgccataacccagatgcccgagcagtgccagttcaaagcggcgcagcgcgggttctggcgtaccagtgacccctgcaagagactgaatgcagtgcaagtaatcgaaaaaaagttcagagaagcgcgtctcgtattccagtacgcgggagagaagttcgttgatgtacagaccgctgtaaagcgtgataccgcttaatggcagcgccagcgagacggcttcagcactgcgcagcgttttgacttcgccacgcccgccaaaacgtagcaagagaggggtgaaaggctgtaatgcacctttcagggtagagcgtttagagcgtgcgcctttggcaaccagacgcacgcgccccgattcctccgtgaagacgtccagcatcaggctggtttcgctccacgggcgactatgcaggacaaatgcgcgctgccagccttccatcggagttactcttaaagatcgtcaacgtaaccgagactgcgcagtgcgcgttcgtcgtcggcccaaccggatttcacttttacccacagttcaaggtgaacaggcgcttcgaacatttcctgcatgtctttacgcgcttcaatcccgatggttttgatcttggcccctttgttgccaatgaccatcttcttctgcccttcacgctcaacgagaatcaaaccgttgatgtcataaccaccgcgttcgttagagacgaaacgttcgatctccacggtcacggagtacggcagttcagcgccgaggaaacgcatcagtttttcgcggatgatttcagacgccataaaacgctgtgagcgatcggtgatgtaatcttccgggaagtgatgagtcgcttcaggtagatgcttacgcacgattgccgcaatagtgtcaacattcagcccggtttcggcagagattggcacgatatcgaggaagttcatctggcttgccaggaactgcaggtgcggcagcagatcggctttctcctgcacgttgtccactttgttcaccgcgaggattaccggcgctttgccttcgcgcagtttgttgagcaccatttcgtcgtccggcgtccagcgggtgccttcaacgacaaaaatcaccagctcaacatcgccaatagagctgctcgccgctttgttcatcaggcggttaatggcgcgtttttcttccatatgcaggcccggtgtatcgacgtagatcgcctgatacgcgccttcagtatggatccccacaatgcggtgacgagttgtctgcgccttgcgggaagtgatggagattttctgccccagcagtttgttcaacaatgtggatttgccaacgttcggacgtccgacgatggcaataaatccgcagtaacttttatcgatgctcattccagctccagttttttcaacgcctgttcggcggcagcctgctcagccttacgacggcttgaacctgtgccaaccaccggttcactcaggccgctgacctggcagtggatagtaaattcctgatcgtgcgcttcgccacgtacctggactaccagataagtcggcagcggcagatggcgaccctgcaaatattcttgcaagcgcgttttcggatctttttgtttatcgcctgggctaatttcgtccaaacgagtttgataccagttgaggattaatttctcgacggtttgaatatcactgtcgaggaatacgccaccaattaatgcttcgacggtgtcggcgagaattgactcacgacgaaatccaccgcttttaagttcacctggccctaaacgtaagcactcgcctaactcaaattcgcgcgccagttccgccagcgtattgccacggaccagcgtggcgcgcatccggctcatatcgccttcatccacacgagggaaacggtgataaagcgcattggcgataacgtagctcagaatagagtcgcctaaaaattctaaacgctcgttatgtttactgctggcactacgatgagttaatgcctgctgcaacagttcctgatgattaaaagtgtagcccagcttccgttgaagccgattaattacgatggggttcatgcgataccaataaataaatgcgtcaacaattcagcacacgaaacagacctgatatacatggttctgctaactgcttcgctgcagtttcagtttaccggtatatggggaccaacgctgtttcgtgtgccgtggcaacctggaggtgccaaccttaaacttcgggggaatattctatacacaacgacgggggatgtcgttagccacgggagatttatctcataaataattcacgttgtcgccataacggcgacaacgtgaacgaagatggctattaatggatgccgccaatgcgacttaagcgcagaccagtcggccattcgccttcttgcttatcgaagctcatccagatagccgttgcccgaccgaccagattcgcttccggcacaaagccccagtaacggctgtccgcgctgttgtcgcggttgtcgcccatcatgaagtattgtcccggaggaacaatccaggttgccagttgttgccctggctgctggtaatacatccccacctgatcctgcgcaatcggcactgtcagaatgcggtgcgtcacatcacccagtgtctctttacgctcggaaagacgaattccattttctttggtttcgtttttcggcacttcaaagaatccgctggtcgcttccccaccattacggcgtgagaaggtctgaacgaaatcgctcggttccacgtttgagtaggtgaccggcagcgcgttttcacacgcctggccggaactgcatcccggttgaatcgtcagctcttttgagaccggatcgtaagtgactttatcgcccggtaaacccaccgcgcgcttgatgtaatcaagctttggatcttccggatatttaaagaccacgatatcgccgcgtttcggatgaccggtttcgatcagcgttttctggtagataggatctttaatgccataagcaaacttctctaccagaataaaatcaccaattaacagagtcggcatcatcgaacctgacgggatctggaacggttcataaataaacgaacgcacaatcaatacgatagccagtaccggaaaaacagaagcaccggtttccagccagccaggcttcggcgcaacctttttcaacgttgctttatccagtgagtccccggcagccgcctgcgccgctgcctgacgttcccgccgtttaggtgcgaaaaagaatttatccacgcaccataaaatgcccgtcaccagtgtggcaatcaccagaatcagggcaaacatattcgccatgccaactcctaagggttatttgttgtctttgccgacgtgcagaatggcgaggaacgcttcctgcggcagctcgacgttaccgatctgcttcatgcgtttcttaccttctttctgcttctgcagcagctttttcttacggctgatatcgccgccataacatttagccagtacgtttttacgcagctgtttcacggtggatcgcgcaatgatgtgcgtaccaatcgctgcctgaatggcgatatcaaactgctggcgtgggatcagatctttcatcttctccaccaactcgcgaccgcggttttgcgaattatcacggtgggtgatcaacgccagcgcatcaacacgttcaccgttgattaatacgtctacacgtaccatgtcggacgcctggaagcgcttgaagttgtaatccagagacgcataaccacgcgaggtagatttcaggcgatcgaagaagtcgagcaccacttccgccatcgggatctcgtacgtcagcgccacctgattaccgtggtaaaccatattggtctgcacgccgcgtttttctacgcacaacgtaataacgttgccgagatatgcctgcggcagcagcatgtgacactctgcaatcggctcgcgcagttcgtagatgttatttaccgcaggcagcttggatgggctgtcgacgtagataacttctcttgacgtggtttcaacttcatacactacggtcggcgcagtggtgatcagatccagatcgtattcacgttccagacgttcctggatgatctccatgtgcagcaggccgaggaagccgcagcggaaaccaaagcccagcgcgctggagctttccggctcatagaacagtgaggcatcgttcaggctgagtttacccagcgcgtcacggaaggcttcatagtcgtcggaacttaccgggaacagaccggcgtatacctgcggtttgactttcttaaagccaggcagcgccttttctgccggattacgcgccagcgttaaggtatcgccgactggagcgccgtggatatctttaatcgcacatacgagccagcctacttcgccacatttcagttcagtgcggtcaacctgtttcggcgtgaagatgcccagacggtcggcgttataggtctgcccggtactcatgactttcactttgtcgcccttacgcagggtgccgtttttaatacggataagtgaaacaacgcccaggtagttgtcgaaccatgagtcgataattagtgcctgcaacgggccttccggatcgccttccggcggcggaatgtcgcgcaccagacgttcgagaacgtcctgcacaccaacgccggttttcgctgaacagcgcaccgcgtcggtggcgtcgatgccgacgatatcttcaatttcttccgccacgcgttcaggatcggctgccggcaggtcaatcttgttcagtaccggcacaacttcgagatccatttccatggcggtgtagcagtttgccagggtttgcgcttctacgccctgcccggcgtcgaccaccagcaatgcaccttcacaggcagccagcgaacgggaaacttcataggagaagtctacgtggcccggggtgtcgataaagttaagctgataggtttcgccgtcagacgctttgtagtccagcgtcacgctttgcgctttgatggtaatgccacgctcacgctcaagatccatggaatcgagaacctgcgcctccatttcacggtcagacaggccaccgcagatctggataatacggtcagacagcgtcgatttaccgtggtcaatgtgagctatgatcgaaaagttacgtatattcttcataaagtatgattattgtgccttaatgcccggttaaccaggcttttagaagtcgctgttctgagcttaacgtctgtattaatagaaacgccgcattctacactacaacattgaggcgaggaaatgttcataccgtatggattgtggtatctggaaacgtcctcgcatttgttatgcaaaatgcaacaaagccagtgaaatcactggctcgcgtcttccgaagatgtttcaaatcgcacaaggccaggcggcaatgccacgcttaagatgatcggttgccattctgcccgggcagcaaacttacgcgagtagccgcgcgcaatcaggaacccgccaataccaccgaggatcgcaccacataatgctgcgacgtcagaagcaaagagtagctgaaatagcgaagcgataaggaataatcccaccagcggcgacatataaaccagtaatgcggagctaagcaggctgccttcggcgatccccaattccactttttgccccggcactaacggctcatcacagggtacgacaatggtatgcgtggtttgcgggccaagtttatttaacacgcggctaccgcaaccggcgcgtgaagcgcagctgctgcatgaagctttaacatcacaactgaccagcgcctgcccgttttgccaggagacgacggtagcccactctttgatcattgcgctgccccgaacttaatattctcggcaatgcgtttcgccgtttgcggcggcagttcaccgacaatggtgatttcggcgttatcacgtacgcttgtactgacggttctgcgtccggtgcgcaacatctgatcggtgctcgatggcgtagcgcggttaacgtttaccgagaagctgaataatccgtcggaatagagacgtgattcgataggcatgttgtccatcgtcggtagcggacgtcgactactggaaacttcgctaaaaccctgtggcaaccaggttggcgtccagctgaatttagctttttcacctacaggaacagaaagcaacggcggcaaatttgccttcgccagcgtctgcatactgctgctgatatcctgattgacgttaaaagcaatcacgcgaaattgttccagcgtttcaccatcgcgatcaaggagatcaacccgcatcggtaatttcgattcggtgtccatccacacgatgtagctgtagcgtgtaccatctcgggcaaccacgcgaatgacttcgcaaagacgatcagcaatacgcgtgcgcccgacggagataaagtcgtagtaaggagaaaggcgtttgaaatcggtatagataagcgatggcagagaatcaacaatgtaatcgccattaagcgtgaacggttcaagtcccggttcaaaatagctgatttcattgccgcgctgtaccacttcccggcgcgggccatccatttgcaacaattgtgcaagaggacggttatcgaggcgtgcatgtcgataacgcagagactcaacaccctgtttattgatgctgatgaatgacagctcgtaattcagtgactgactggccaggttcatctgctgtaataacgccccggacgcgggagtggccgaggcgttagcagagaataacaggctacctgtcactaatgacatggcaaaccaaagttgcttcattactgcgattgcgttcctaaagtttgaattcctggcacctgtacagcggcttgctgggtttgcgcctgctcaaactgaagctgttcagagtggagtcggcgttgcagttcgtaatcctgcaacattgcattaatgcgacgacgctgctcctgtacctgctgctgttgaccattgtttgcggtcgcttcagaaggtactcccaggcttaccgggctggctttacccatcatcggcagtgtattaaataccggcgtttcgggctgctgggacgtttcagattgtccattatagtgctggacgccaacgataactgcaagcgatacgcatgcggctacgcccatttgggtaagctgtgccgcccacggacgtactttctgccagaatggcattttctgccattgatgcggcgcaggctgggcttccgggatcaatgtcgccggttgacgtactggctcttcttcaatggcggccatcacgcgtgaagagatatcgaaatggagcacctcgggagtatcaccccgcattgagtcacggattaagtgatagctttcccaggttttctgcatttctgggttatgagccagttcgttaagcagctcactatccagcgtttcgccatccattaaagcggaaagttgttctttctgcatgcctaatacccttatccagtatcccgctatcgtcaacgcctgataagcggttgaactttgttatcaatagcttccctcgctcggaagatacgtgaacgcaccgtacctaccggacaatccatgatagcggctatctcttcatagctcaggccatccagctcccgcaaggttattgccatgcgtaaatcttccgggagggactcaatagttcggaaaactatctgtctcagttcttctgacaacattaagttctcagggttcgaaatttctttcaacgcgccgccactttcgaagttttcagcttcaatggcatccacatcactggaaggtggacgacgcccctgagcaaccaggtaatttttcgctgtatttacagcaatccgatacagccatgtataaaaagcgctatctccccggaacgaatccagcgcacgataggctttaataaaagcttcttgtaccacatcgggaacatcacccgacggcacatagcgggaaaccagactcgccactttatgctgatagcgcactaccagtaagttaaaggctttctgatctcccttctggacccgttcaaccaggacctggtccgttaactgctcgctcatccgaggtaaagtctccccaaaccaaatttccacgcgctatcgaaacgccactccattagctgcaatttgagcaagcaaagggttagagtgtctcgtttttgtaaagttccgtaacgcatctgtttttgtttgtcatgctgtagacggatcattatctatcattataagtctacagaatctgaacatcgcattatctgtgtagaaatgcccatttaactgcctgaagagtaacccaacggcctttttatttcaccacctaatcctccaccagccagtaacttctctttttctcgccgccctgcgtcagcgtgtttagcaactgtaacaaatattaaaatagcaggtgtttatccgcacaacatgatgctatgctgaccaaaccatgtttagtaaattaaacaaagaaaatgaatactctccctgaacattcatgtgacgtgttgattatcggtagcggcgcagccggactttcactggcgctacgcctggctgaccagcatcaggtcatcgttctaagtaaaggcccggtaacggaaggttcaacattttatgcccagggcggtattgccgccgtgtttgatgaaactgacagcattgactcgcatgtggaagacacattgattgccggggctggtatttgcgatcgccatgcagttgaatttgtcgccagcaatgcacgatcctgtgtgcaatggctaatcgaccagggggtgttgtttgatacccacattcaaccgaatggcgaagaaagttaccatctgacccgtgaaggtggacatagtcaccgtcgtattcttcatgccgccgacgccaccggtagagaagtagaaaccacgctggtgagcaaggcgctgaaccatccgaatattcgcgtgctggagcgcagcaacgcggttgatctgattgtttctgacaaaattggcctgccgggcacgcgacgggttgttggcgcgtgggtatggaaccgtaataaagaaacggtggaaacctgccacgcaaaagcggtggtgctggcaaccggcggtgcgtcgaaggtttatcagtacaccaccaatccggatatttcttctggcgatggcattgctatggcgtggcgcgcaggctgccgggttgccaatctcgaatttaatcagttccaccctaccgcgctatatcacccacaggcacgcaatttcctgttaacagaagcactgcgcggcgaaggcgcttatctcaagcgcccggatggtacgcgttttatgcccgattttgatgagcgcggcgaactggccccgcgcgatattgtcgcccgcgccattgaccatgaaatgaaacgcctcggcgcagattgtatgttccttgatatcagccataagcccgccgattttattcgccagcatttcccgatgatttatgaaaagctgctcgggctggggattgatctcacacaagaaccggtaccgattgtgcctgctgcacattatacctgcggtggtgtaatggttgatgatcatgggcgtacggacgtcgagggcttgtatgccattggcgaggtgagttataccggcttacacggcgctaaccgcatggcctcgaattcattgctggagtgtctggtctatggctggtcggcggcggaagatatcaccagacgtatgccttatgcccacgacatcagtacgttaccgccgtgggatgaaagccgcgttgagaaccctgacgaacgggtagtaattcagcataactggcacgagctacgtctgtttatgtgggattacgttggcattgtgcgcacaacgaagcgcctggaacgcgccctgcggcggataaccatgctccaacaagaaatagacgaatattacgcccatttccgcgtctcaaataatttgctggagctgcgtaatctggtacaggttgccgagttgattgttcgctgtgcaatgatgcgtaaagagagtcgggggttgcatttcacgctggattatccggaactgctcacccattccggtccgtcgatcctttcccccggcaatcattacataaacagataaaaagcctgggtcagcgccgtatacgcttcggaatagttctggtctggcccacgaatgactaagcgatcgctaaagcattctcccgcctgcggggagaatgccagcagcacccgatgcggcagtcgcgcttcgttttccgccacatccgtccgcaaacgtaaatgccagcccatgcttaatgccagctccgtaaaaccattaccaatctgctctggcagcactacgcagaaaaatccctcttcggtaatgcactccgccgcacaggtcagcaacgatgggtgatcaagcgtagtggtatagcgagcctgttcccgttgaggtgtcgagcactctactccctgctgatagtaaggtgggttactgatgattaaatcgaagcgtactgtctgctgtgtgatccactgctgaatatccgccgtatggacgttaatccgctctgcccacggggactggttgatattttcctgcgcctgcgcggcagcttcactttccagttcaactgcatcaatcatcacgctgtcatcggttcgctgcgccagcattaatgccagcaacccgctacccgcgccgatatcaaggcaacgttttaccccagccaccggtgcccatgcgcccaataaaataccatccgttcccactttcatcgcacagcgatcgtgagcaacaaaaaactgtttaaaagtaaatccattacgacgaagcacggatgtagactgtgacatgaaaataaaaccttgcaggaaaaacggcgatagcaccgggtgagaacaatacccgagaagcgatatccatacaaacagatgaagattgcagccgtaacgtctataatcagcgccccacacagaggtagaacatgactgtaacgactttttccgaacttgaactcgacgaaagcctgctggaagccctccaggataaaggtttcactcgcccgaccgccattcaggctgccgccattccgcctgcgctcgatggccgtgatgtactcggttctgcgccgacaggcaccggtaaaacggcggcgtatctgctgccagcgttgcagcacctgctcgatttcccgcgtaagaaatccggtccgccgcgtattttgatcctcaccccaactcgcgagctggcgatgcaggtgtccgatcatgcccgcgaactggcgaaacatacgcatctggatatcgccaccatcaccggcggcgtagcctatatgaaccacgcggaagtgttcagcgaaaatcaggacatcgtggtcgccacgaccggacgtctgctgcaatacataaaagaagagaacttcgattgccgcgcggttgaaacgctgatcctcgacgaagcagaccgtatgctggatatgggcttcgctcaggatatcgaacatattgctggcgaaacgcgctggcgtaaacagaccctgctcttttcggcaacgctggaaggcgatgcgattcaggactttgccgagcgtctgctggaagatccggtggaagtttctgccaatccctccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcgggcatcaacaactgctatctcgaaggtgagatggtacagggcaagcgtaacgaagcgatcaagcgtttgaccgaaggtcgcgtaaacgtactggtcgcaaccgatgttgccgcgcgcggtatcgacattcctgacgtcagccacgtctttaacttcgatatgccgcgcagtggcgatacttatttgcaccgtatcggacgtaccgcgcgcgccggtcgtaaaggcaccgcaatttcgctggtggaagcccatgaccatctgctgctgggtaaagtaggccgctatattgaagagccaattaaagctcgcgttattgatgagttacgcccgaaaacgcgtgcgccaagcgaaaagcagaccggcaagccatcgaagaaagtactggctaaacgtgctgagaagaaaaaagctaaagagaaagagaagccgcgggtgaaaaaacgccatcgcgacaccaaaaatattggtaagcgccgtaaaccaagcggaacgggcgtgccaccgcaaacgacagaagagtaatctcaatgccaggtttaagcctggtattaaaagtgctggcaaacgcaaaactgcctgatgcgctacgcttatcaggcctacgtggctcatgcaatatattgaatttgcacgatcttgtaggccggataaggcgttcacgccgcatccggcatgaataaagcgcactttgtcgacaagttaaatgccgggtttaatcccgacattatttttatccagccacaaaactctcttcaacacactgaataaaagtgtgcatcgccgggctaaccgcttttccagcatgatgtgcgcacatggccgtaatggtctgcgactgttcgccaaaaggcaattcaattaattctccgcactccaactcttttgccaccgcaaagcgcggtaggtagctgaccccgatattcgccgcgacacaacgcttgatgctttcgatacttataagctcaatggtgttttccaccgtgatccgccgctgacgcagcgtgctctcaaatatctgccggaagacacattgcggttcgttgataataaagctacaggcgttatgtcttcccggctcagtaaaatcgacatctgcaatttgcggtgaagccaccagcaccagtgattgttcacccaactctcgtcgattcagagcatcatcattccctacacgataaaagacgccaacatcggcctcatcattcagtagcgcatcacggatcacgtaacagttcagcgactgcaacgataaacgcacttttggggcgcgttgccgaaaacgctgcaacacctgcggcattcggtaagagagcaacgtttcgcccgaaacaacgcgtagttccccgtccggatctgactcctttttggcagcctcacgaagcgtatccatcactcgggtaagttcataaatgtgcggcagcaacttttttccttcgcgggtaaggcacatccgtcggccaattttctcaaataactggactgaaaactcctgctcaagctgctgaatatgaaaagtcaccgtcgattgtgtacagcacaatttttgcgaagctcgcaaaaaggaaccctcttccaccacggttttaagcgtaataaaacggcgcagatccataaccccaaacctatcgaaaatatcgaatctagaatataaaaacattcatttttttaaatgttccgtgtcgggtactgtctaccaaaacagaggagataacaagtgacaccgacccttttaagtgctttttggacttacaccctgattaccgctatgacgccaggaccgaacaatattctcgcccttagctctgctacgtcgcatggatttcgtcaaagtacccgcgtgctggcagggatgagtctgggatttttgattgtgatgttactgtgtgcgggcatttcattttcactggcagtgattgacccggcagcggtacaccttttgagttgggcgggggcggcatatattgtctggctggcgtggaaaatcgccaccagcccaacaaaggaagacggacttcaggcaaaaccaatcagcttttgggccagctttgctttgcagtttgtgaacgtcaaaatcattttgtacggtgttacggcactgtcgacgtttgttctgccgcaaacacaggcgttaagctgggtagttggcgtcagcgttttgctggcgatgattgggacgtttggcaatgtgtgctgggcgctggcggggcatctgtttcagcgattgtttcgccagtatggtcgccagttaaatatcgtgcttgccctgttgctggtctattgcgcggtacgcattttctattaacgaaaaaaagcggaagaggtcgccctcttccgcttagtaacttgctacttaagccttacaggctttcagtaaaggtacgagcgataacgtcgcgctgctgttccggagtcagagagttaaagcgaactgcataaccggatacacggatggtcagctgcggatatttttccggatgcttaactgcatcttccagagtttcgcgacgcagaacgttaacgttcaggtgttgaccaccttcaacgcgaacttctggtttcacttctactggaacttcacggtattcaatgtcacccagtttgcttactgcaaccacttcatcttctgcataacctgcttttgcaacgatgcaacgcgcttcgcctttttcgctgtccagcagccagaaagagttcagcagatcgtcgttagcggctttagtaatctggatacctgtaatcatgtgatgcctccccggcaaaattatttgatttgttcagcctgtcgcggccaattggtaaaaccattgttgcttgagtgtatatatactcctcaaacacccttgaatctttgatttaaatcaataaaaaccacacatcaagtatggtcgcaaatggattttattgttttacatcaacttatgcgggtgtgaaattttaccaatttacatttttttgcactcgtttaagtctaaaaaatgagcatgattttgttctgtagaaagaagcagttaagctaggcggattgaagattcgcaggagagcgagatggctaacgaattaacctggcatgacgtgctggctgaagagaagcagcaaccctattttcttaatacccttcagaccgtcgccagcgagcggcagtccggcgtcactatctacccaccacaaaaagatgtctttaacgcgttccgctttacagagttgggtgacgttaaagtggtgattctcggccaggatccttatcacggaccgggacaggcgcatggtctggcattttccgttcgtcccggcattgccattcctccgtcattattgaatatgtataaagagctggaaaatactattccgggcttcacccgccctaatcatggttatcttgaaagctgggcgcgtcagggcgttctgctactcaatactgtgttgacggtacgcgcaggtcaggcgcattcccacgccagcctcggctgggaaaccttcaccgataaagtgatcagcctgattaaccagcatcgcgaaggcgtggtgtttttgttgtggggatcgcatgcgcaaaagaaaggggcgattatagataagcaacgccatcatgtactgaaagcaccgcatccgtcgccgctttcggcgcatcgtggattctttggctgcaaccattttgtgctggcaaatcagtggctggaacaacgtggcgagacgccgattgactggatgccagtattaccggcagagagtgagtaaatttgcggggaaatgccggatggcagagttgccacccggctgatttatcaggctttattctgacgccaccattcaccaagcaaaacgccggttgcgacagagatattcagcccggcaacgttgcccgtaccgtcaatcttcacgcgcagatcgttcggatcgcgtgcggcatccggtaacccttcatattcctgacccagcaccagtaccattttcgctggcagactagttttgaacagcggtttaccctgctcgctggaagtggtcactacggtgtaacctgcctgacggaaatcatccagcacgttaacaatgttgtcgccagtaatcggctgaacgtgctctgcgccgccttctgcggtacggatagccgcccccgactccagcagtgccgcatcctgcaccacgacacctttcacgccgaagtgcgcgcagctgcgcatcatgccacccaggttatgcgggttagattcgttttccagtgccagaacgcaatcctgcgcgcctgcctggcttacccactgctgcacggttgtaccgttacgctttttgatcaagaagcaaacgccgccgtgatgttccgtgcctgacgcttttgtcaattccgcttcatccaccacatggtacgctttgcggtttgctgccatccagcgcaaagcttctttaaaacgcggcgttacactctggataaaccaggcgcgaacaatcgcttccggacggctctggaaaagtgcctgacatgcattttcgccgtagacgcgggtttcttccgcacgctgacgacgcaacacttccggatcaataaaacttttaccactgatgccaccgtgatcggccttttccggcgtctcatcacccggcgcgcgggaaaccgtgcgccacggcgaatcttcccacttgcggtcacggggctgactctgtttgtcatcgcgggcggggcgacggccaccgtcagcacgagattttcctggacgcccgccccctttcccggtacgcgggttgtgggtacgtttatcagaatcatcatcactgcggacatacatcactttgaccttgccgcttttacctttcatttcatcgttcatgcttttctccaccagcgctgcgcgaagcgcgcagattacccgaagtccgcgcggttcgccatgatttcgtaccaaagcctgcgactatcatacctattgaataaaacagattgttgtctggaacaatgtccccgataatatgtaacatattagaaacataccggcgtcgttgccgataagtctccttactcatcccgaggttagttatgaataccgtttgtacccattgtcaggccatcaatcgcattcccgacgatcggatcgaagatgcggcaaaatgcggacgctgcggtcacgacttgtttgacggagaggtgattaatgcgaccggtgaaacactcgacaaattgctgaaggatgatctacctgtggtgatcgacttctgggcaccgtggtgcggcccctgccgtaatttcgcaccaatttttgaagatgtcgcgcaagagcgtagcggtaaagtgcgctttgtgaaagtgaataccgaagctgaacgtgaattgagcagtcgctttggaattcgtagtataccgacgatcatgattttcaaaaacggtcaggttgtcgacatgcttaatggcgcagtaccgaaagcgccgttcgatagctggctgaacgaatctctttaatcttaccggggcgcatcttgtgccccgttttctcctctgcgacaatggcgttttttcgacgctctcttatgaccgaaaacgctgttctccagttacgcgccgagcgtattgcgcgcgcaacacgtccttttcttgcccgcggtaatcgcgttcgtcgctgccaacgctgtcttttgccagagaaattatgtctctgttcgacaattaccccagcacaagcaaaaagtcgcttctgtttgctgatgttcgacaccgagccaatgaagcccagtaataccgggcgtctcattgctgatattttgcctgataccgttgcgtttcaatggtcgcgtaccgaaccctcgcaggatttgctggagttggtgcaaaacccggactatcagccaatggtggtctttcccgcttcgtatgctgatgagcaacgggaagtgatcttcacaccacctgccggtaagccaccgctgtttatcatgctcgatggtacctggccggaagctcgcaagatgtttcgtaaaagtccgtatctggataatcttcccgtcatttccgtcgatctttcccggctttctgcctatcgcctgcgtgaagcccaggctgaaggccaatattgtactgccgaggtagccatcgcactgttagatatggccggcgataccggggcggcggcagggttaggcgagcattttacccgctttaaaacacgctatctggcaggaaaaacgcaacatctgggtagcatcacagcagaacagttagaaagcgtttaaaatcattcggtcacttctgcgggagaccggtatgagtcagcgaggactggaagcactactgcgaccaaaatcgatagcggtaattggcgcgtcgatgaaacccaatcgcgcaggttacctgatgatgcgtaacctgctggcgggaggctttaacggaccggtactcccggtgacgccagcctggaaagcggtgttgggtgtgttggcctggccggatattgccagcttgccctttacacccgaccttgcggttttatgtaccaatgccagccgtaatcttgctcttctggaagagctcggcgagaaaggctgtaaaacctgcattattctttccgccccggcatcgcaacacgaagatctccgcgcctgcgccctgcgccataacatgcgcctgcttggaccaaacagtctgggtttactggctccctggcaaggtctgaatgccagcttttcgcctgtgccgattaaacgcggcaagctggcgtttatttcgcaatcggctgccgtctccaacaccatcctcgactgggcgcaacagcgtaagatgggcttttcctactttattgcgctcggcgacagcctggatatcgacgttgatgaattgcttgactatctggcacgcgacagtaaaaccagcgccatcctgctctatctcgaacagttaagcgacgcgcgacgctttgtttcggcggcccgtagtgcctcgcgtaataaaccgattctggtgattaaaagcggacgtagcccggcggcacagcgactgctcaacacgacggcaggaatggacccggcatgggatgcggctattcagcgtgccggtttgttgcgggtacaggacacccacgagctgttttcggcggtggaaacccttagccatatgcgcccgctacgtggcgaccggctgatgattatcagcaacggtgctgcgcctgccgcgctggcgctggatgccttatggtcacgcaatggcaagctggcaacgctaagcgaagaaacctgccagaaactgcgcgatgcactgccagaacatgtggcaatatctaacccgctcgatctacgcgatgacgccagcagtgagcactatattaaaacgctggatattctgctccacagccaggattttgacgcgctgatggttattcattcgcccagcgccgctgctcccgcaacagaaagcgcgcaagtattaattgaagcggtaaagcatcatccccgcagcaaatatgtctctttgctgacgaactggtgcggcgagcactcctcgcaagaggcacgacgtttattcagcgaagccgggctgccgacctaccgtaccccggaaggaaccatcactgcttttatgcatatggtggagtaccggcgtaatcagaagcaactacgcgaaacgccggcgttgcccagcaatctgacttccaataccgcagaagcgcatcttctgttgcaacaggcgattgccgaaggggctacgtcgctcgatacccatgaagttcagcccatcctgcaagcgtatggcatgaacacgctccctacctggattgccagcgatagcaccgaagcggtgcatattgccgaacagattggttatccggtggcgctgaaattgcgttcgccggatattccacataaatcggaagttcagggcgtcatgctttacctgcgtacagccaatgaagtccagcaagcggcgaacgctattttcgatcgcgtaaaaatggcctggccacaggcgcgggtccacggcctgttggtgcaaagtatggctaaccgtgctggcgctcaggagttgcgggttgtggttgagcacgatccggttttcgggccgttgatcatgctgggtgaaggcggtgtggagtggcgtcctgaagatcaagccgtcgtcgcactgccgccgctgaacatgaacctggcccgctatctggttattcaggggatcaaaagtaaaaagattcgtgcgcgcagtgcgctacgcccattggatgttgcaggcttgagccagcttctggtgcaggtttccaacttgattgtcgattgcccggaaattcagcgtctggatattcatcctttgctggcttctggcagtgaatttaccgcgctggatgtcacgctggatatctcgccgtttgaaggcgataacgagagtcggctggcagtgcgcccttatccgcatcagctggaagaatgggtagaattgaaaaacggtgaacgctgcttgttccgcccgattttgccagaagatgagccacaacttcagcaattcatttcgcgagtcaccaaagaagatctttattaccgctactttagcgagatcaacgaatttacccatgaagatttagccaacatgacacagatcgactacgatcgggaaatggcgtttgtagcggtacgacgtattgatcaaacggaagagatcctcggcgtcacgcgtgcgatttccgatcctgataacatcgatgccgaatttgctgtactggttcgctcggatctcaaagggttaggcttaggtcgacgcttaatggaaaagttgattacctatacgcgagatcacggactacaacgtctgaatggtattacgatgccaaacaatcgtggcatggtggcgctagcccgcaagctcgggtttaacgttgatatccagctcgaagaggggatcgttgggcttacgctaaatcttgcccagcgcgaggaatcatgagtaaggtactggaaatgttgaccacttaatcgggactggtgttattattgcccgcttatgtcgtctgcattgcacagaggacccttcaatgaacagagaagaaatgcactgtgatgttgtcaaaatttaagcgtaataaacatcaacaacaccttgcccaactacccaagatttctcaatcagttgatgatgtcgatttcttttacgctcccgccgacttccgggagacgctgctggaaaaaatagccagcgcgaagcagcgcatttgcattgtcgccctgtatctcgaacaggatgacggtggcaaaggcattctgaacgcgttgtatgaggctaaaaggcagcgtccggaactggatgtgcgggtgctggtcgactggcatcgtgcacaacgtggacgcattggcgctgcggcatctaacactaacgctgactggtactgccgcatggcgcaggaaaatccgggcgtagatgttccggtttatggcgttccaatcaatactcgtgaagcccttggtgttctgcactttaaaggctttatcatcgacgatagcgtactttatagcggtgccagcctgaacgatgtttacctgcatcagcacgataaatatcgctacgaccgttatcatctgatccgtaaccgtaagatgtcagacattatgtttgaatgggttacacagaatattatgaatggccgcggcgttaatcgtctggatgatgttaatcggccaaaaagcccggaaatcaagaacgatattcgtctgttccgccaggagctgcgtgatgccgcttatcatttccagggcgatgccgacaacgatcagctttctgtaacgccgctagtggggctggggaaatcgagtctgttgaacaagaccattttccatcttatgccttgtgccgagcagaaactaaccatctgtacgccatacttcaacctgccagcaatccttgtgcgcaatattatccagttgctgcgcgaagggaaaaaggtcgaaattattgttggtgataaaaccgcgaatgacttctacattccggaagatgaacctttcaagataattggcgcattgccttatctctatgagatcaatctgcgtcgtttcctgagccgtttgcagtattacgtcaatactgaccagctagtggttcggttatggaaagatgacgacaacacctatcacctgaaagggatgtgggttgatgataagtggatgttgatcaccggtaataacctgaacccgcgcgcctggcgtctggatctggaaaacgccattttgatccacgatccgcaacttgagctggcgccacagcgagagaaagaactggagctgatccgcgagcataccaccatcgttaagcactatcgcgatctgcaaagtattgccgattatccggtgaaggttcgtaaactcatccgccgtttgcgccgtatccgcatcgaccgattaattagccgcatcctgtaatcacaaccccgtcctgtacggggtttgttttttggaggccacgttttgcgtattctttttgtctgttcgctattgttactttctggatgcagccatatggctaacgatagctggagcgggcaggataaagctcaacactttatcgcctcggcgatgctttccgccgccggaaatgaatattcacagcatcaggggatgagccgggatcgcagtgccatgtttggattgatgttctctgtcagtttgggggcgtcaaaagagctttgggatagccgccccgaagggagcggctggagctggaaggatttggcctgggatgtcgccggtgcaagcaccggctataccgtctggcaactgacccgtcactaaagacgcatccccttccctttgcgatgtagcatcaaagaaaccagaaacgccaccacggccatcaaggtcacataccagaagaaggctgtttccattcctattgatttcagcgacaacgctacgtactccgccgaaccaccaaatatagcattagcgaccgcatatgacagaccaacgcctaatgcgcgaacctgtgccgggaacatctcagccttcagtattccactgattgatgtataaaaactcactatcagcagggcacacatcaccagaccaaaagcggcataaggcgaggaaacgttttgcaatgctgagagaataggaacggtaaaaatggctgccagcgaaccgaaacataacattgaggtacggcgaccaatcttatccgacagcgcgccaatgagtggttgaataagcatgaatacaaacaatgcggcagtcataatgccactcgccacgttggcatgcattcccgcagtatttaccagatacttctgcatataagtagtgaaggtatagaaacaaagggagcccgcagcggtaaaaccgagaaccatgatgaatgcacggcgattgcgccataatcctttcagagatccagcttcttttaaagcgcgcgtttcttgttgcgaagtttcatctaactgacgacgtaaccacaacgccacaacagctaacacagctcctaacgcgaaaggaatacgccatccccactctctgagtgcagcgtcttccatggtgtgttgtaaaaccacgacaaccagtagggctagcagttgtccgccgatcaacgtcacatactgaaatgatgcgtaaaaacctttgcgcccttcaacggcaacttcactcatataggtggcgctggtgccatattctccgccaacagataatccctgaaataaacgagcgagaagcaataatgccggagcccacgtacctatagtttcataacctgggaggcaggcgataaccagcgatccgaaacacatcatacacaccgataacagcatcgattttttgcgaccatgtttatcggctatgcggccaaatagccaaccgcctattgggcgcatcaggaatcccgcagcaaaaacacctgctgtttgtagtagttgagtcgtcgtgttcccggaagggaagaagatgtgggcaaagtagagtgaacagaacgagtagacatagaaatcgaaccactcgaccagattacctgaagaggcccccacaatcgcccaaatgcggcgacgagtatcactacttgtcagtttgctgtctgccgttacagtactttcagccatgccattatgtctcctgccgtaatccgatgcttttgtcggtcgcttttgtttattttttttgtaaaggaaatattatacatttgttgcatatcattatgcaaccttaaccatgaatttagttagcaggaaaatggttattgaggagcttaaggataaatttctggtaaggaggacacgtatggaagtgggcaagttggggaagccgtatccgttgctgaatctggcatatgtgggagtataagacgcgcagcgtcgcatcaggcatttttttctgcgccaatgcaaaaaggccatccgtcaggatggcctttcgcataatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccatccgcgagggacctcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcattgttcagtgtttcaattttcagcttgatccagatttttaaagagcaaatatatcaaacaagacttaacagtctgttttgagatattgaggtcggcgactttcactcacaaaccagcaagtggcgtcccctaggggattcgaacccctgttaccgccgtgaaagggcggtgtcctgggcctctagacgaaggggacacgaaaattgcttatcacgcgttgcgtgatattttcgtgtagggtgagctttcattaatagaaagcgaacggccttattctcttcagcctcactcccaacgcgtaaacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgaaggtccccctctttggtcttgcgacattatgcggtattagctaccgtttccagtagttatccccctccatcaggcagcttcccagacattactcacccgtccgccactcgtcagcgaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagtgccgcttcgctttttctcagcggcgcggggtgtgcataatacgccttcccgctacagagtcaagcatttctttgcttttctctgttgagattctcaggagaaccccgccgacccggcggcgtgtttgccgttgttccgtgtcagtggtggcgcattatagggagttattccggcctgacaagcgaaaaatataaaaactttatcgttcgctcacttttcaggcaaaacatcttaaatatagtcttttccgtctaacttatagacaaaaacgagccccgaagggctcgttttatcatttactggacggcgacaatccggtcttcattaacttccaggcgaatcactttacccggaaccaattcaccagacagtatttgctgtgccagcgggttttcgatctgctgctgaattgcacgtttcagaggacgtgcaccatagaccggatcgtaaccgttctcgctcagcagtttcagcgcctcgtcagaaatgtggatttcataaccacgttcttccagacgtttgtacagacgtttcaactgaatctgcgcaatcgaggcaatgtgctgttcacccagcggatggaagaccaccacttcatcgatacggttaatgaattccggacggaagttatggcttaccacaccgagcaccagctctttcatgtgcgcataatccagttcaccgaagcgttcctgaatcagatcggaaccgaggttagaggtcataatgacgaccgtattacggaagtcgaccgttctcccttgcccgtcagtcagacgcccatcatccagtacctgcaacagaatgttgaagacatccggatgcgctttttccacttcatccagcaggatgacggaatacggacgacgacgcaccgcttcggtcaggtagccaccttcttcataaccgacatatcccggaggcgcaccaaccaaacgagacaccgagtgtttctccataaactcggacatatcgatacggaccatcgcctcgtcgctatcaaacataaagttcgccagcgccttacaaagctctgttttccccacaccagttgggccgaggaacaggaatgaaccaatcgggcgatttggatccgccagccccgcacggctacgacgaatagcgttagataccgcatcaaccgcttcgttctgaccaattacgcgatggtgcagttcttgctccatacgcagcagtttttcgcgctcgctttccatcatgcgagaaaccggaatccccgtccaacgcgccagcacttcagcaatttcggcgtcggtcactttattacgcaacagacgcatagttttgccttcgagctgcgttgcggcttccagttgcttttccagttccgggattttgccgtattgcagttcagacatccgcgccaggtcccccacacggcgagcctgttcaatagcgattttcgcctgttccagttccgctttaatggtctgcgtaccagaaagcgatgccttctctgctttccactcttcttctaactcggagtactgacgttctttgtcgctcagttcttcgttgagcatatccagacgttttttactggcttcatcagactctttcattaacgcctgttgttccagtttgagctggatgatacgacgatcgagtcggtcgagttcttctggttttgagtcaatctgcatacgaatgctggatgctgcttcatcgatcaggtcgatggctttatccggcagctgacggtcagcaatgtagcgatgagacaacgtcgccgctgcaacaattgccgggtcagtaatttgcacatggtggtgcaattcgtaacgttctttcaggccacgcagaatcgcaatggtatcttcaacagaaggctcggcaacaaacactttctggaaacgacgttccagcgcagcatctttttcaatgtactggcgatattcgtcaagcgtcgtggcacctacgcagtgcaattcaccacgcgccagcgccggtttcagcatgtttccggcgtccattgcgccatcggctttacccgcgccgaccatggtatgtaattcgtcgataaataggatgacgttgccttcctgtttggcaagatcgttaagcacgccttttaaacgttcttcaaactcaccgcgatatttcgccccagccaccagcgcgcccatatccagcgccagtacccggcggcctttcaacccttccggcacttcgccgttgataatacgctgcgccagaccttcaacgatggcagttttaccgacgccgggttcaccaatcagtaccgggttatttttagtacgacgttgcagcacctgaatggtacggcgaatttcttcatcacgaccaatcaccggatcgagtttgccctgttcggctcgttcggtaaggtcgatggtatattttttcaaagcctgacgttggtcttcagcaccttgatcgttcacgctttcacctccacgcatttgttcaatcgcttgagtaatgttggcggtggtcgcccctgctgctttcaggatgtcggccagcgtgccgcgagactcaagtgccgccagaacgaacagttctgacgagataaagttatcaccacgtttttgcgccagcttgtcgcaaagattaagaacgcgcaccagatcctgtgatggctggacatcaccaccagtaccttcaacctgcggtaaacgatttaatgcctgattgatatctgtgcgcaactggccagcatttatgccagcggatgttaataaaggactaaccgaacccccttcctgattcagcagggcgctcattaaatgaagtggttcgataaattggttgtcgtgcccgagtgcaagtgattgggcatcggcaagagcaagctggaatttattagtaagacgatccagacgcataactcctcccataacggatcaaagttgctactggagattaaatgaggtcatccctcaattattcaaggttattgaccagattaatgtgaaaagaaaatcacgcgtaccggatcgtcttgattctttaggttatatcagccaaatgaaacttgccatacgaccggtggtcttgtcgcgacgataagagaagaaagtctcattttccgtatatgtacaacggtcgccgccgaaaatttgctcaacacccacgttcgccagacgctgccgggcaagctgataaatatccgccagatacttatcaccatgctgaatgaaagctgcacttgctttagcgtctactgccataaacgcctcgcgaacctccccccccacttcgaacgcgcgtggaccaattgccggccctaaccaggcgagaatattttccggattatcagcaaaacaggaaaccgtctcttccagcacgcctgcgcacagtccacgccagccagcatgagcggcggcgacttccgttcccgctcgattgcaaaacagcacagggaggcagtcggcagtcatcactgcgcaaaccgtgccgggcgtattgctataagaggcatccgcccgttttgaggcataaggttcgccagtgagcttaagcacatctttgccgtgtacctgctcaagccagaccggtttagaaggcaaattgcccgcagcaaaaagtcgcttgcgattctcctcaacgtgatccgggttatcgccacaatgggcaccgaggttgagtgagtcatacgggggcaagctcacgccgccgatacgagtggagctacaggccgcaacaccttttggctgcggccactgcgggacaatcagcttactcataaccagtccacttcatccttatgttcttcgaaatcggcgcgcatcacctcaatcagctccaccatatcttgtggaataggcgcatgccattccatttcgatgccggagatcgggtgataaagacgcagcatggttgcatgtagcgcctggcggtcaaacttacgcagcgtggagataaatgcttccgaagcaccttttggcggacgcggacggccaccataaaccggatcgcccaccagcggatgagtgatatgggccatatgcacgcggatctggtgcgtacgtccagtttccagacgcaaccgcagacgcgtgtgcacacggaagtgttccatgatgcgatagtgagtcaccgctggtttgcccatcggatgcaccgccatatgggtacgtttggtcgggtggcgactgattggctcgtccaccgtgccacctgcggtcatatgaccaatcgccaccgcttcatactcacgagtaatttcacgccgttgcaaagattcgactaaacgcgtctgagccggaacggtttttgccacaaccatcaggccagtggtgtctttatccagacgatggacgatgcccgcacgcggtacatcggcaatgggtggatagtaatgaagcaacgcattcagtaccgtgccatccgggttacccgcgccaggatgtaccaccaggtcgcgcggtttattaatgataataatgtcttcatcttcatagacgatatccagcgggatatcctgcggttcaaaacgcgcttcttcttcaatctcagcgttgatggcaacctgctcgccacccaatactttttctttcggcttatcacaaactttgccgttaaccagcactcgctggtcgaggatccattcttttattcgcgaacgtgaataatccgggaacatttcggccaaagcctgatctaagcgttgaccgagttggttttcggacaccgttgcagtgagctgtactcgttgtgccatatatactgcttcttcgtttatcgttggggttttacggctttgccgtttaatatagtgtgctattgtagctggtcttaaccgggagcaggaacagagaatctcccgtattacattttgaggaaagtcaaaacgtcatgacgcgcatgaaatatctggtggcagccgccacactaagcctgtttttggcgggttgctcggggtcaaaggaagaagtacctgataatccgccaaatgaaatttacgcgactgcacaacaaaagctgcaggacggtaactggagacaggcaataacgcaactggaagcgttagataatcgctatccgtttggtccgtattcgcagcaggtgcagctggatctcatctacgcctactataaaaacgccgatttgccgttagcacaggctgccatcgatcgttttattcgccttaacccgacccatccgaatatcgattatgtcatgtacatgcgtggcctgaccaatatggcgctggatgacagtgcgctgcaagggttctttggcgtcgatcgtagcgatcgcgatcctcaacatgcacgagctgcgtttagtgacttttccaaactggtgcgcggctatccgaacagtcagtacaccaccgatgccaccaaacgtctggtattcctgaaagatcgtctggcgaaatatgaatactccgtggccgagtactatacagaacgtggcgcatgggttgccgtcgttaaccgcgtagaaggcatgttgcgcgactacccggatacccaggctacgcgtgatgcgctgccgctgatggaaaatgcataccgtcagatgcagatgaatgcgcaagctgaaaaagtagcgaaaatcatcgccgcaaacagcagcaatacataacagaaacctgaaacacaaaacggcagcccttgagctgccgtttttttattctgtcagttgtgaaactgaagcgatttagtcgctatcgatctcatcaaatatggctcgctttgagatattcctcaagtaaaaaaacatctcttcctgcgatttctcacaaaaaagattcgttgacaaaaagtgacaaaattatgagattttcatcacacattttgacatcaggaacggtatgctgaattcaccaagacgggaagacaagaggtaaaatttatgacaatgaacattaccagcaaacaaatggaaattactccggccatccgccaacatgtcgcagaccgtctcgccaaactggaaaaatggcaaacacatctgattaatccacatatcattctgtccaaagagccacaagggtttgttgctgacgccacaatcaatacacctaacggcgttctggttgccagtggtaaacatgaagatatgtacaccgcaattaacgaattgatcaacaagctggaacggcagctcaataaactgcagcacaaaggcgaagcacgtcgtgccgcaacatcggtgaaagacgccaacttcgtcgaagaagttgaagaagagtagtcctttatattgagtgtatcgccaacgcgccttcgggcgcgttttttgttgacagcgtgaaaacagtacgggtactgtactaaagtcacttaaggaaacaaacatgaaacacataccgtttttcttcgcattcttttttaccttcccctgaatgggaggcgtttcgtcgtgtgaaacagaatgcgaagacgaacaataaggcctcccaaatcggggggccttttttattgataacaaaaaggcaacactatgacatcggaaaacccgttactggcgctgcgagagaaaatcagcgcgctggatgaaaaattattagcgttactggcagaacggcgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccaacaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagcttgtcgattgttggcgagatgacgttaactatcgaccattgtttgttggtctccggcactactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcaaatcagcgacaaaacttcacccgatttgtggtgttggcgcgtaaagccattaacgtgtctgatcaggttccggcgaaaaccacgttgttaatggcgaccgggcaacaagccggtgcgctggttgaagcgttgctggtactgcgcaaccacaatctgattatgacccgtctggaatcacgcccgattcacggtaatccatgggaagagatgttctatctggatattcaggccaatcttgaatcagcggaaatgcaaaaagcattgaaagagttaggggaaatcacccgttcaatgaaggtattgggctgttacccaagtgagaacgtagtgcctgttgatccaacctgatgaaaaggtgccggatgatgtgaatcatccggcactggattattactggcgattgtcattcgcctgacgcaataacacgcggctttcactctgaaaacgctgtgcgtaatcgccgaaccagtgctccaccttgcggaaactgtcaataaacgcctgcttatcgccctgctccagcaactcaatcgcctcgccgaaacgcttatagtaacgtttgattaacgccagattacgctctgacgacataatgatgtcggcataaagctgcggatcctgagcaaacagtcgcccgaccatcgccagctcaaggcggtaaatcggcgaagagagcgccagaagttgctcaagctgaacattttcttctgccaggtgcagcccgtaagcaaaagtagcaaagtggcgcagtgcctgaataaacgccatattctgatcgtgctcgacggcgctaatacgatgcagccgagcgccccagacctgaatttgctccagaaaccattggtatgcttccggtttacgtccatcacaccagaccacaacttgctttgccaggctaccgctgtccggaccgaacatcgggtgtagccccagcaccggaccatcatgcgccaccagcatggcctgtaatggcccatttttcactgatgccagatcgaccagaatacaatctttcggtaaaggcggtaatttgccaataacttgctcagtaacgtggattggcacactaacaatcaccattccggcatcggcaacaatatcagccgctcgatcccagtcatgttgctccagaatccgcacctgataacccgagagggtcagcatcttctcgaacaggcgtcccatctgaccgccaccgccgacgataaccaccggacgcagtgacggacaaagtgttttaaatcctttgtcgttttcactggagtaagattcacgcatcacccgacgcaaaacatcctcaatcagatctggcggtacacccagagcttccgcctctgcacgacgcgaggccaacatagatgcctcgcgctccggaacataaataggcagtccaaagcggcttttcacctcgcccacttcagcaaccagttccagacgcttcgctaataaattcagcagcgctttatcgacttcatcaatttgatcgcgtaatgcggtcaattcagcaaccataataaacctcttaagccacgcgagccgtcagctgcccgttcagatcctgatgaatttcacgcagcaaggcatcggtcatttcccagctaatgcaggcatcggttacggatacaccgtatttcatttcactgcgcggttgctcggaagactgattgccctcgtggatattactttcgatcatcagaccaataattgagcgattgccatctttgatttgagcaaccacggattctgccaccgcaggctgacggcgataatctttattggaattaccgtggctgcaatctaccatcagagacgggcgcagtcccgcctgttccatctctttttcacattgcgcaacatccgcagggctatagttcggcgctttaccaccgcgcaggatcacatggccgtccggattcccctgagtttgtagcaacgcaacctgccctgcctggttaatgccaacaaaacggtgcggctgggcggcggcgcgcatagcgttaattgctgttgccagactgccgtcggtgccgtttttaaaaccaaccggcatggaaagcccggaggccatttcacggtgagtttgcgattccgttgtacgagcaccaattgctgaccagctaaacagatcgcccaggtattgcgggctattcggatctaacgcttccgtcgccagtggcagtcccatattcaccagctcaagcagcaatttacgcgcgatctgcagcccggcttctacatcaaaagagccatccatatggggatcgttaattaaccctttccagccgacagtggtacggggtttttcaaaatagacgcgcattaccagatagaggctatcgctgacctctgcggcaagggctttaaatcgacgagcatattccagagcagtttccggatcatgaatggaacaaggaccacatactaccagcagacgaggatcgcgcccggcgataatatctgaaatgcttttacgcgagtcagcaatctgggcttcttgttgcaggctcaatggaaaagcggccttcagttgttccggagtcattaaaacctgttcgtcggtaatatgtacgttattcagcgcgtctttttgcatgatggcgatcctgtttatgctcgtttgcgatagttgatcctcagcgaggatgacgtaacgataacacataaagtaaagttttcaatccatatttcgtacatttttatttacacaggcaatttagtcgcgctttcaacccttacctctgtatagataaatttacactccctttgaaaacaatccgctatgctttgaaaaaggagaaagaaatgatgaaaaagtttatcgcccccttgttggctttactggttagcggatgtcagattgatccttatactcacgcgccaaccttgaccagcaccgactggtatgatgtcggtatggaagatgcgatatcgggcagcgccataaaagatgacgatgcatttagcgattcacaggcggatcgcggtctataccttaaaggatatgccgaaggacaaaagaaaacttgccagaccgattttacttatgcccgaggactttccggtaaaagctttcctgccagctgcaacaatgttgaaaatgccagccaactgcatgaagtatggcaaaaaggggctgatgaaaatgccagcacaatacgattaaattaattaaaaccccacaaataaattaaacataagattttactcattgtgttttatttctcacattgatgacggtcgcatgaaaaaatgatattttaatgagcattctgaaaaaatatcgatgcatttcgagcgaagatggtggggatccctgaatgcgtttttctcaccgactgttcttacttctgattctcctgctgacgggagcaccaatactcgctcaggagccttctgacgttgcgaaaaacgtgcgtatgatggtttccggtattgtcagttacacccgctggcctgcgctatcagggccaccaaagttatgtatcttttcatcttcacgttttagtaccgccctacaagagaatgccgcgacatctttgccttatctgcctgtcatcattcacactcaacaagaggcgatgatttcaggctgcaatggtttttattttggcaacgagtcaccgacattccagatggaattaaccgaacaatatccgtcaaaggcgttattattaattgccgaacaaaataccgagtgcattattggtagcgccttttgtctgatcatccacaataatgacgtcagatttgccgtaaacctggatgccttatcgcgtagcggtgtaaaggtcaacccggatgtcttaatgctcgcacggaagaaaaatgatggataacgataattctcttaataagcgccccacgtttaaaagagcattacgcaacatcagtatgaccagcatatttatcactatgatgctgatctggttgctgctttccgtgacctcggtgctgaccctgaaacagtacgcgcaaaaaaacctggcactgacagcagcaacaatgacttacagtctggaagcagctgtcgtttttgccgatggccctgcagcaactgaaacactggcagcgctgggccagcaagggcaattttcaactgcagaagtacgtgataagcagcaaaatattctggcatcctggcattacacccgtaaggatccaggcgatactttcagtaatttcataagccactggctcttccctgcccccatcattcagccgattcgtcacaatggtgaaaccattggcgaagtacgcttaaccgctcgcgacagttcaatcagccattttatctggttttcgctcgccgtactgaccggttgtattctgctggcatcaggcatcgcaattaccctcacccgccatttgcacaatggcctggtagaagcgctgaaaaatatcaccgatgtcgtacatgatgtgcgttccaaccgcaatttttcccgacgagtttcggaagaacgtatcgctgagtttcaccgcttcgctctcgacttcaacagtctgctggatgaaatggaagagtggcagcttcgtttacaggctaaaaatgcgcagcttctacgtaccgcgctacatgacccattaaccgggctggctaaccgcgcagcgtttcgtagcggcatcaacacgttgatgaacaattccgatgcccgaaaaacgtcggcgttactatttcttgatggcgataatttcaaatacatcaatgatacctggggtcatgcgacgggcgatagagtcttgattgaaatcgcaaaacggttagctgaatttggcgggctgcgacataaagcataccgcctgggcggcgatgaattcgctatggtgctctatgatgtacagtcggaatctgaagtgcagcagatatgttcagcactgacacaaatctttaatctcccgtttgatcttcataatggccatcagaccaccatgacattaagcattggttacgcgatgaccattgagcacgcctctgcggaaaaattacaagagcttgccgatcacaatatgtatcaggccaaacaccagcgtgccgaaaagctggtgagataacaaggatatatcgatatgataaagcacctggtagcacccctggttttcacctcactaatactgactggctgccagtcccctcagggaaagtttactcctgagcaagtcgccgctatgcaatcttatggatttactgaatccgccggcgactggtcgctgggcttatcagatgccattctgttcgcaaaaaatgactacaaattgctcccggaaagccagcaacagatccaaaccatggcagctaaattggcctcgacagggctaacacatgcccgtatggatggacacaccgataactatggtgaagacagttacaacgaaggcttatcattgaaacgggcgaatgtcgtggccgatgcatgggctatgggtggacaaattccacgcagcaatctcaccacacagggtttaggaaaaaaatatcccatagccagtaacaagaccgcccagggccgcgccgagaaccgccgcgtcgcagtggtgattactaccccttaaaacaccagcaaacagataaaaaagggccagccaattggccagcccttcttaacaggatgtcgcttaagcgaaatcttagttaagacgctctttgatacgagcagccttaccagtacgctcacgcaggtagtacagtttagctttacgaacagcaccacgacgtttgacagaaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgttttttggaaccttcaacaacccatactttcacttccacggtatcacccggacggaaggaaggtacgtcctgcttcatctgctcttgttcaagttgcttaataatgttgctcataatttaatctcttatcctgggtaaactgatatctcgggggcttacgccatcccatcatgtttatgttgctgttgtgcgtgttccgttttgaactccgccagcaaccttgcttgctcttcagtcagagccaggttttccagaagttcaggtcttctaagccaggtacggcccagcgactgtttcaaacgccagcgacgtatctcggcatggttgcccgacagtaacactggcggaacttccatcccttctaacacctcaggccgcgtatagtgcgggcaatccagcaatccttcagcaaaggaatcttccgttgccgaggcttcatgtcccagtactcccggaataaaccgggaaacggagtcaatcagcgtcattgctggtaactcaccaccactgagaacgtaatcgccgattgaccattcttcgtcaatttcggtttggatcacgcgctcatctataccttcgtagcgaccgcacaccagaatcaatttttgattcgttgccagttcgctgacgcccgcttgatcaagcttgcgtccctgtggtgacagataaatcacctttgcgccttcacccgccgcggcttttgctgcatgaatggcgtcccgcaagggttgcaccatcattaacatccccggtccgccgccgtaaggacgatcgtccacggtacggtgccggtcatgcgtgaagtcgcgaggactccagctctggatgctcagcaggccatttttaactgcccggccagttaccccgtaatcggtaattgcgcggaacatttcaggaaacaggctaattatgccaatccacatagcgccgtcttttaccgtttatccggtggtttaaaaaccaggatcccaatctacttcgattgaacgagtagtgagatcgactttcttgataacctgcccatcgaggaacggtacgagacgttccttgataccaaacgcatctttcaggtttgccttaatgacgagaacgtcattagatccggtttccatcatatcgacgactttaccgagatcgtagccttcagtggttactacctggcagcccatcaggtctttccagtagtagtccccctcttcaagctgaggcagctgcgatgaatccacgacaatttcacaattcgtcagcaggttcgccgcatcacgatcgtcaacgcctttcagcttgatgatcatgtcctgattgtggtgcttccagctttccagctggacttgctgccactgacccgccttctggataaaccagggctgatagtcaaaaatgctttcggcgtcttcggtggaagaaaacactctgagccacccacgaataccgtaagacgaacccatttttcccaaaacgatgggatcaacaggtgcttgcgcggtgagttgtttgctcatcatgaccaccgtgacagattaagctgctttgtttacttctttgatcagcgcagcaacgcgatcagaaatagttgcgccctggccaacccagtgagcgatgcgatccagatccaggcgagtgccttcttctttttcgctagcgattgggttgaagaaaccaacgcgctcgatgaagcgaccgttgcgtgcattacggctgtcagcgacaacaacctggtagaacggacgctttttagcgccgtgacgtgctaaacgaatagttaccataacatcctcttgtgtgaataaaacaaccggaccccatcgaggaacggagtccggtgtcatattaaaagcccgaaaattttactcatttttgcgggaattgcaatcaacagttgctaactctgctgtaaaaggccgtcggcggtgcagccagtttggtgccggagtgcgcgcagtcaccggagcgtacacgcagtacgtgaggatgacgagcacatcccggtgccaaaatggcaaacaagccaggccgattagcgaccagggaagcctgggggcatcatacccttcatgcttctcatcatcttcgccattccgcccttcttcattttcttcatcatgcgctgcatgtcgtcgaactgtttcagaagacggttaacgtcctgcacctgcataccgcaaccggcagcaatacggcgtttacgcgaacctttgatgatttctggcttagcgcgctctttcatcgtcatcgagttgatgatggcttccatacgcaccagcactttatcgtccatctgtgacttgacgttatccgggatctgccccatgcccggcagcttgcccatcagactagccatgccgcccatatttttcatctggcgcagctgctcaagaaagtcgttgagatcgaagccgtcaccttttttcagcttgctggctaatttctctgcctgcgcgcggtcaactttgctttcgatatcttcgatcagcgacagtacgtcgcccatgccgagaatacgcgacgcgatgcggtccggatggaacggctccagcgcctcagttttctcgccaacaccgaggaacttgatcggtttgccagtgatgtgacgaatagagagcgccgcaccgccgcgggcatcgccgtccactttggtcaacactacgccggtaagcggtaacgcttcattgaatgcttttgccgtattggccgcatcctgaccggtcatggcgtcaaccacaaacagggtttcaaccgggttaatcgacgcatggacttgtttgatctcgtccatcatcgcttcgtcaacgtgcagacgaccagcggtatccaccagcagcacgtcgtagaatttcagtttggcttctttcagcgccgcgttaacgatatctaccggcttctgaccaacatcagaagggaagaaatcaacgcccacctgctctgccagcgtctcaagctgtttgattgccgccgggcgataaacgtcggcagaaaccaccagcactttcttcttgtgcttctcgcgcaggaacttaccgagtttaccaacgctggttgttttaccggcaccttgcaggcccgccatcagtacgaccgcaggcggttgcgcagccaggttcagggtctggttctcttcgcccatcgccgcaaccagttcgttacggactattttgacgaactcctgccccggcgtcaggctcttattaacttcatgaccaaccgctttctcttttacgcgattgataaactcacgcactaccggcagagctacgtccgcctccagcagcgccatgcgcacttcgcgcagcgtatcttttacgttgtcttcagtgaggcgtccacggccactgatattgcgcagcgtgcgcgacaaacgatcggttaaattatcaaacattgtctctcgcctggggtggaaacggttggccgcaatcgcgacacatcatcagtattttgccgcagtataacatgaaggcgtctttgttgttatgcaacggttggagcagcgttcacctgacgctatactgcttctctttcttattgctcaaactgtcgacatcactatgcccgtttttgctctgctcgcgcttgtcgcctactccgtcagtcttgcgctgattgttcccggtctgctgcaaaaaaacggcggctggcggcgcatggctattatttctgcggtcattgcgctggtctgccacgcaatcgctctggaagcccgcatcctgcccgacggtgatagcggacaaaacctcagcctgctgaacgttggttcattggtcagtttgatgatctgtacggtaatgaccattgtggcttctcgcaatcgtggctggctgctgctacccattgtctatgcctttgcgcttatcaacctggcgctggcaaccttcatgcccaatgaatacatcacccatctggaagctacgcctgggatgctggtgcacattggcttatcgctcttttcctatgccacgctaattatcgccgccctgtacgcgctgcaactggcgtggattgattaccaactgaagaacaagaagctggcgtttaaccaggaaatgccgccattgatgagtatcgagcgtaaaatgttccacatcacgcagattggcgtggtgctgctaacgctcacgctttgcactggcctgttctacatgcacaacttatttagcatggaaaatatcgacaaggctgtgctctctatcgtggcgtggtttgtctatattgtgctgctgtggggacattatcatgaaggatggcgtggacgccgcgtcgtctggtttaacgttgcgggcgcggtaattctgacactggcctacttcggcagccgaattgtccagcagttaatcagctaaacccagaaaaggagtttcccctggaacacatttctactactacgttgatcattattctgatcatcatggtggtcatttcagcctatttttccgggtccgaaaccggaatgatgaccctcaaccgctatcgtctgcgacatatggcgaaacagggtaatcgctcggccaaacgcgtcgaaaaattgctgcgtaagccagaccgcctgataagcctggtgttaatcggcaataacctggtcaatattcttgcctccgcgctcggcactattgttgggatgcgtttgtacggcgatgcgggcgtggcaattgcgactggtgtgctgacttttgtcgtactggtatttgctgaggtattgccgaaaaccattgccgcgctgtacccggaaaaagtcgcttatccgagtagttttctgctggctccgctgcaaattttgatgatgccgctggtctggttgctgaatgctatcacccgtatgctgatgcgcatgatgggtatcaaaaccgatatcgtggttagcggctctttgagcaaagaagagttgcgcactatcgtgcacgaatcacgctcacaaatttcccgtcgcaatcaggatatgctgctgtcggtgctcgatctggaaaaaatgaccgttgatgacatcatggtgccgcgcagtgaaattatcggtattgatatcaacgatgactggaaatcgattctgcgccaactctcccactcacctcacgggcgcatcgtgctctaccgtgattcgctggacgacgccatcagtatgctgcgagtacgtgaagcctggcggttgatgtcggagaaaaaagagttcaccaaagaaaccatgctgcgcgccgcggacgagatctattttgtgccggaaggtacgccgctcagcacgcagttggtaaagtttcagcgcaacaaaaagaaagtcggcctggtcgtcaacgagtatggagacattcaggggctggtgacggttgaagatattctggaagagattgtcggcgatttcactacgtcgatgtcgccaacacttgccgaagaggtcacgccgcaaaacgacggttcggtgattatcgatggcaccgccaacgtgcgggaaatcaacaaagcctttaactggcatctaccggaagatgatgcccgcacggttaatggcgtcattcttgaggcactggaagagatccctgtcgcaggcacccgcgtgcgtattggcgagtacgatatcgatattctcgacgtacaggacaatatgattaagcaggtaaaagtttttcctgtgaaaccgctgcgcgagagtgtggcggagtaacgaaaacggcccggcattcgcatgcagggccgtgaattattacgaaagcagaaattaagcttttgctttcgctacagtaaccatcgccgcacgaatcgtacgaccattcagcgtataacccttctgcataatgcccagtacgttacctggcgcaacgtcatcagattccaccattgcgatggcctgatgcacattcgggtccagtgggacgttagtttcggcgatcacttcaacgccaaacttacgcacaacatccagcatcgacttcagcgtcagctcaatgccttcaaccatcgcagacatatccgggttagctttatcagccacttccagcgcacgatccaggctatcaatcaccggcagcaattcgttgatgaatttctccagcgcgaatttgtgggctttttcaatatccagttcagtacgacgacgcaggttttccatttcggcttttacacgcaaaatgccgtcacgttcacgggtctgggcttcagccagctgagcttcgagattcgcaactttttcatcgcgcggatccacctgctcagcagaagcttctggctcaactgcctcaatctcttcgtgctgatccatgataatttcttccggggcttgcccctcaggcgttttctgttctttactactcatgaatttctccgcgtttttttcgcattcatctcgctaacttcgcttattatggggatcagtttcagggtttcaagggaagcactcacattgtcatcaatcttcgcaacaaggacctcggaaaaatgaataatcatttcaagtgtattggcattgtgggacacccacggcaccccactgcactgacaacacatgaaatgctctaccgctggctgtgcacaaaaggttacgaggtcatcgttgagcaacaaatcgctcacgaactgcaactgaagaatgtgaaaactggcacgctcgcggagattgggcaactagctgatctcgcggtagtcgttggtggcgacggtaatatgctgggcgcggcacgcacactcgcccgttacgatattaaagttattggaatcaaccgtggcaacctgggtttcctgactgaccttgaccccgataacgcccagcaacagttagccgatgtgctggaaggccactacatcagcgagaaacgttttttgctggaagcgcaagtctgtcagcaagattgccagaaacgcatcagcaccgcgataaatgaagtggtgcttcatccaggcaaagtggcgcatatgattgagttcgaagtgtatatcgacgagatctttgcgttttctcagcgatctgatggactaattatttcgacgccaacaggctccaccgcctattccctctctgcaggcggtcctattctgaccccctctctggatgcgattaccctggtgcccatgttcccgcatacgttgtcagcacgaccactggtcataaacagcagcagcacgatccgtctgcgtttttcgcatcgccgtaacgacctggaaatcagttgcgacagccagatagcactgccgattcaggaaggtgaagatgtcctgattcgtcgctgtgattaccatctgaatctgattcatccgaaagattacagttatttcaacacattaagcaccaagctcggctggtcaaaaaaattattctaattttacgccagcctctttactgtatataaaaccagtttatactgtacacaataacagtaatggtttttcatacaggaaaacgactatgttggcacaactgaccatcagcaactttgctatcgttcgtgagcttgagattgattttcatagcggcatgaccgtaataactggcgagaccggcgcgggtaaatctattgcaatagatgccctcggtctttgtctcggtggtcgcgctgaagccgacatggtgcgtaccggcgctgctcgcgctgacctgtgcgcccgtttttctctgaaagatacgccagcggctctgcgctggctggaagaaaaccagcttgaagacgggcatgaatgtttgcttcgtcgcgtgatcagcagcgatggtcgctcccgtggtttcatcaacggtacagctgttcctctgtcacaactgcgcgaactgggtcagttgctgattcagatccatggtcagcacgctcatcaattactcaccaaacctgagcaccaaaaattcctgcttgatggctatgccaatgaaacctctctactgcaggaaatgaccgcacgttatcagttgtggcatcaaagctgccgtgacctcgcgcatcatcaacagttaagtcaggaacgcgccgcccgtgcggaactgctgcaataccaattaaaagaacttaacgaatttaatccgcagcccggagagtttgaacaaatcgacgaagagtacaaacgtctggcgaacagcggtcaattgctgaccaccagccagaatgcattggcattaatggccgacggtgaagacgcaaacctgcaaagtcagctttacacggctaaacaactggtgagcgaattgattggcatggacagcaaactgtccggcgtacttgatatgctggaagaagctaccatccagattgctgaagccagcgatgaactgcgccactactgcgatcgtctggatctcgatcccaaccgactatttgaacttgaacagcgcatctcaaaacagatttcgctggcacgtaaacatcacgtcagccctgaggcattgccacagtattaccagtcgctactggaagaacagcagcaactggacgatcaggccgactcacaagaaacgcttgcgctggcggtaacgaaacatcatcagcaggcactggaaatcgcgcgcgcattacaccaacaacgccagcaatatgcagaagaacttgcacagctgatcaccgacagtatgcatgcgctctcaatgccgcatgggcagtttacgatcgatgttaaatttgacgagcatcacctgggcgctgacggtgccgatcgtattgagtttcgggtaaccaccaacccaggtcagccaatgcagcctattgccaaagtcgcatccggtggtgaattgtcccgcatcgcactggcaatccaggtcatcacggcgcgtaaaatggaaaccccggcactgatttttgatgaagtggatgtagggattagcggtccaacagcggcagttgtcggcaaactgctgcgtcaactcggcgaatcaactcaggtgatgtgtgttacccacctgccacaagtcgcgggatgtggtcatcaacactattttgtcagcaaagaaaccgatggtgcgatgacagaaacgcatatgcaatccctgaataaaaaagcgcggttacaagagctggcgcgcctgcttggtggcagtgaagtcacacgtaatacactggcgaatgcgaaagaactgcttgcagcgtaaacttttttcctgcttcacggtcagagtaaacagcaaaacgccgtaagaccggaaagcaaaaggttttaaagtgatgaaaggtctattatcatcggcatattacagatgagccacgtactgctcgggcccgaaaaggaatcaaatcactatgcgctgtaaaacgctgactgctgcagcagcagtactattgatgttgaccgcaggctgttccactctggagcgagtggtttaccgtcctgacatcaaccaggggaactatctgaccgctaacgacgtatccaaaatacgtgttggcatgacgcaacaacaagttgcgtacgcattgggtacaccgctgatgtccgatccatttggtacgaatacctggttctatgtcttccgccagcaaccaggtcatgaaggtgtaactcagcaaacgctgacgctgacctttaacagtagcggtgtgttgaccaatattgataacaaacctgcgctgagtggtaactaataataaagttgctctcaaagacgttaaaaaaggtgctcaatgagcaccttttttctgtctgttatttattcgctgatttttctgctcgttgcctgcgaagctctttcggatcggcaatgagagggcgataaatctccacccgatcgccatcatgcacactatcgcttagttttgccggacggctgtaaatgccgactttgtttttagttaaatcgatatcggtacgcaattccagcaagccactggcgcgaatagcttcttcaaccgtcgcgccctcctgcagcgtcactcgctgcaggtactgcttctcaggtagcgcataagccacctcaacggcaattttacctggcactgtaaacctctttcgcacgaaccgtaaaagcctggaccatattagccgccagctctttaaacacgcgaccaaaggcgagttcaatcaacttattggtaaactcaaagtcgagatgaaactcgatacgacacgcctcctggctcagcggcgtaaacttccatccaccaatcaatttcttgaacggcccatccaccagattcataagaatactttggttactggtcaactggttgcgggtagtaaacgttttgctgatcccagccttagagacatctaccgccgcagtcatctgcccaggagtggactccagaatccgacttccggtacaacccggcaaaaactgaggataagactgaacgtcattcactaactgatacatttgctccgcgctgtagggtaccagtgcggtccggctaatctgaggcataacaatttccatcaacaaaaatccaacaaataatatcatttatcctgctgtaaaaaaaacgctatcccggcgctgggtaacatcgggttcatgctaagatagagccttgtcccccgcaggattgatatggggtgttttcgatttcagattaccgatgattcacgacgcttatgacgaagaaaaaagcacataaacctggttcagcgaccatcgcgcttaacaagcgcgcccgtcacgaatactttatcgaagaagagttcgaagcgggacttgccctgcaaggctgggaagttaaatccctgcgcgcaggaaaagccaatatcagcgacagctacgtccttctgcgtgacggagaggcatttctgtttggcgctaacatcacgccaatggccgtggcctccacgcatgtggtgtgcgatcctacccgtacccgcaagttacttctcaaccagcgcgaactggactcattgtacggtcgcgtcaatcgagaaggctataccgtagtggcgctctccctgtactggaaaaatgcctggtgcaaagtgaaaatcggcgtcgccaaaggtaagaaacagcacgataaacgttcagatatcaaagagcgcgaatggcaggtggataaagcacgtatcatgaaaaacgcccaccgttaaacctgcactccaattattgaccagttcctcaccgcgcctccctctccggcggcgcgaatgaacatcttattggctatcacatccgacacaaatgttgccatcccattgcttaatcgaataaaaatcaggctacatgggtgctaaatctttaacgataacgccattgaggctggtcatggcgctcataaatctggtatacttacctttacacattggggctgattctggattcgacgggatttgcgaaacccaaggtgcatgccgaggggcggttggcctcgtaaaaagccgcaaaaaatagtcgcaaacgacgaaaactacgctttagcagcttaataacctgcttagagccctctctccctagcctccgctcttaggacggggatcaagagaggtcaaacccaaaagagatcgcgtggaagccctgcctggggttgaagcgttaaaacttaatcaggctagtttgttagtggcgtgtccgtccgcagctggcaagcgaatgtaaagactgactaagcatgtagtaccgaggatgtaggaatttcggacgcgggttcaactcccgccagctccaccaaaattctccatcggtgattaccagagtcatccgatgaagtcctaagagcccgcacggcgcaagccctgcgggcttttttgtgccctcaatttgtcccgcgaagtccgaagagaactaattaaatccgaaccttttaggcccattgataggcccaacgaaaagctctattgtttacgttgggcctaaacgcagggagactccccatggcaagaaaaaccaagccgttaactgatacggaaatcaaagccgccaaacctaaagatgccgattaccagctttatgacggtgacgggcttactctgttaatcaagtccagtggcagtaagctttggcaattccgttactatcggcctttgaccaagcagcgaaccaaacagagcttcggtgcctatcctgccgtctcgctttctgatgcacgtaaactcagagccgaatctaaagttttattggcgaaagacattgatcctcaggaacatcagaaagaacaggtgaggaattctcaagaggccaaaaccaataccttcttgttagttgccgagcgttggtggaatgtgaagaaaaccagcgtaacagaggactatgccgacgatatctggcgctcgcttgagagagatattttcccggcaatcggtgatatcagtatcactgagattaaggctcatactctggttaaagcagttcagccggttcaggccagaggtgcattagagactgttcgccgcctttgtcagcgtattaacgaagtcatgatttatgcgcagaacacaggcctgattgatgctgttcctagtgtaaatatcggaaaagctttcgagaaaccgcaaaagaaaaacatgccaagcatccggccggatcaacttccgcagctaatgcacaccatgcgtacggcaagtatcagcatgtccacaagatgcctgttcatgtggcaacttctaaccatcacccgccctgccgaagctgctgaggctcgatgggatgagatcgatttcaatgctagcgaatggaaaattcctgcagctcgaatgaagatgaaccgggaccatacggttccactatctgatggggctcttgctattctggaaatgatgaagcctctcagtggtggccgagaatttatctttcctagccgtatcaagcccaaccaaccaatgaatagccaaacagtgaatgcagcactcaagcgtgctggcttaggaggtgtacttgtttcacacggcttgcgttctatcgccagtacggcactcaatgaggaaggatttccacctgatgtcattgaagcagcgcttgctcatgtagacaaaaatgaggtgcgtcgcgcttataaccgcagtgattatcttgagcaacgtcgtccgatgatgcaatggtgggctgatctcgtaaaagcagcagatagtggtagcatcgttttaactcatttgagcaaaattcgtcttgtcggataaaatatttatcagcccagctctctgggctgatatttctaaaagatcgcactaaatagctacgcggaatagtgctctactttcgtttagccctttcagaggtaagacattagggcaatttcactgtatgactgcgcagtcatcgagtctgtggggtgttgctccttttgcaacgtatcacttgtcaataaatagaaagtgtagatgtattaggcgcagctatttagtctatatggcaagtagtaattatttacttcttttttttctacgaacagcgctatcgaaagcttgttttacatcttcattttttaaagaccattgatttaaaatagtatcaaccaaagcatcttgactcattgttgctacacgatattttttattttgattatttatctcaaactctgacatttgaataaaatcccatagcggttcgataagttcattaactgctacaaccttatttttccacccatcattcggaacagagtcattaattagctcaaccaacttcagttgaatgatatggtacacttccgctttgcttttgccacccttctttcctgcactccgcctgacttctgataattttttttgattacaaacagagatgttaaaccaagtcatacctatgcacttatcaaataactccgcagcccgatgaaatgctttaaaggcaacgttttcattttcagacatgatagattttccccagaaaaaagagattgaggcgaacataaggtgtgccttgaaaatgtcattaatggaaaatggctcgataacaagaggtaaaaacgtttccttggtaaggtttgaacttagatttttccagcattcttgagctggatcatataattcagtgtattcttcctttatctccagttgcccattcactgtatggtgccttgtttcccatggtacatcgcaggaatataacctcacacgagtacctattttctcagagctccagaattgctctcgcattctgcctagctcaatccgtatttccggatgatcttcctctagaacatcagtatccaccgcccattcgcattcggacatgtgataggcgagatcacgtcgttttctacaaatttgttcataaaaatcattcagagaaatcataaaaccaccataaatcaatgtattagaggttgtaaaaattgtatttttggtacatgggttttttgccttaaagatacccattaatctctctgcaaccaaagtgaaccaatgagaggcaacaagaatgaacaatcgatcggccgttagaatactacggttaccagcggttatccaaaaaacaggtatggcacgggccaccatctatgactggttgaaccccaaatcaccacgatacgatgccacctttcccaaaaagcgaatgctcggcgtgaaatctgtcggatggattgaggccgagattgatgagtggttatcacaacgctgtaaacttatttgagggtgttacatgaattcatactcaattgctgtcatcggagtgtaaacatcctgctatttccgccattaatagcggaatagccatatttgctaaacaatttcttaatttaattaaataagaggcattgcatgttcaatggtcgtcctttccctgtagatgcatttcctaaaattatcaggaatgcaatttatgaagtggaacagcatacgcaggcccctcaaggtttgattgctgcttctgctcttggggtaatttctcttgcctgtcagaaccggattgatgtttgccgattgaataatctacgtggcccggtatcacttttcttaatgactctggctgaatcaggtgaacgtaagagtacggttgataaactgctgatgaagccattatatcaactggaagaggatttatttgaaaaatacacccacgatcttaccgcatggagaaatgatgaagcaatttttaatattgaaaaaaaagcactgatgtcaaaacttaaatcagatattcgacgtaacaaagatcacttggcaacaaatgaaagacttaaagaactacttacgacaaacccgaaagctccagtgagattcaaatttttatttaacgatgccacacctgcagctattaaagctcatctctgtgggcactggcgatcagtcggcatcatgtctgatgaagctgggatcatttttaatggttacacacttaacgagctgccgtttatcaataagatgtgggatggttcaatatttacggtggaaaggaaaaacgagcccgagaaattaattagagatgcaagaataacactgtcgctgatggtccagcctaatgtttttaagggttatatcgacaggaaaggagatatggcaaaggggattggattttttgcacggtgcctcatgtgccagcctgcttcaacacaaggtaacagaaaaatttccaacccaattttttcaaatgaacatttgccggtatttcaccaacgtcttatggaaattgttaatgagagcatcattaaaattaatgaaaataatcgcatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgcagtaaaagcagcagtggagatagtggcttggtatattgaagaatacatccgcttgttctctaaaaaagaagagttttctttagatgtttcagaagcagatgagctttattgttggataaaagattactgcacgcaaaaattttcttcctgcatcaagaaaaatattatcttacaatttgggccaaataaatttagaaatcgtgacaaggcaaatgaattaattagaatcttaatttcacaaaacaaaatatttatatcttcatggggtaaaacaaaaataataaacataactcattgtgttttttgattttaatgacaatctaaaaggacttaatttaagagtaaaaacaaactctaaacccagttcggataaaagcttgtcatcttgataggtaatatataggtacatagacacatcagaacgatcacttactccaatatcattggccaggatactatatgacatacgatagtgaattcggatcacatgtatccctatatcgggatagaatcaaacaggttattgatgactccctaaacgaacatcttaactcaatgattctacgtgttgatctgcatgacccaattgatacagaaaatatggataacccattctttcaacccagggttgactctggtgctatatctcgctttaccagtgcgttaaaagcaaagcttaaacatgataagcatattaaaactcaacggaaagactggcctgatagtcgacattccactttacgttacgcatgggtcagagaatataccaaaaatagaaagcggcattaccatttgatactgtgtttcaatcaggatgcttattatcatttaggtgattacgacttaaaccgtaacacgttacgtacaatgataacgacagcttggtacagtgcacttggcatccctatagatagctcggggaagttagttaattacccgccaaatggcaaataccttctcaatcgtaaaagggacaactttgagcagacttatagcgatttgatgaatagggtggattacatgaccaaagtaaggactaaaatagtcggtgacggagaccgtaatttcggctgcagtcgcgggtaatttattttttacaacaatggcctttcttatggctggaaaggcctgatttgtttgtattaagatatcggtaatcttttgatggttggaagcccgtcctggtagacgacctagcctaccgaagatgtgagttattcaaaaatgtcgctttcccgcgttccgtagacaaacgtacctaaatcaatgtcgtctaataccgagcgcgcgcctgataaacatctgatcaacgtacccaatcgatctactccaaatgtcctgagtatcccgaagatactggctcaactcatccacatcagcctcgtcggaaaattccagcaagtctaccagtcggtgtaacgtctgaatgggaatgccaatctcttctaaggcattgacacctggtggtagatggaaactttcgaacgccaatttgacatgtgtgtaatcgactttgctgcgtataccacgctttacagcgtggtgtttaactacatcctccatcaagctgagcaccttaggtagggtatagccgaaggtattggttatgagcttcaaatcattgttgagggcaatggaaagagtacgtttctccccttcagaaatccactgtcgtgcataatcgatctgatttttcagatattccgaataactttcagcacttaaatagccggcaagttttgcgatcatgacatccgtaggcttaacagggaccccattgcgactgaacgtatggggaaccagtctggcaatgatctttgcaaaggtcttgaggaagtttgtcgcgggagtccagtgaaacactaacgaggaaaattcgttatcgtccatcatctcgaacatgctttgcagcatttcgaactgctcgacacggaagtacgaatgcttcttcacaaggtcgatggaaacacggtcgtttatgaaaacctcatcaaagcgatcctgtgaaaactcggacaagtggtctggttgaacgctggctaacaggttgattggggtatcaatgccctgaataccgagcggaatatccacctcttgattgagattgtcttccgggatttcctccaggcaaaagattttgccgacgaagtgaacgcccatgcgcccggcgcgacctttgatgttcccatgggtgaatttgtcaatgctgcgagttccatcgcggttgtcgtagatcacaacgttcttagcgatagtgttgactccttcaatgatcgtggaggtgcagagcaaaaagcgcagttttccagcattgaattggtcggcagtgtattgctgcagtgccctcggtagcgcgccaaaatgcaagccaataccgtttctaagggcgactgtgtaatcccagtcggcatcgaactcttcgctgacccagtcgacatggggattctcagtcggagtgccatgcccaagcctgatcagctcgcgcgccaccaggcccgcaacagttggtgacttgcaataaatgatcgttgcgtcgacacatgcgtgcgcgatttcccccagcgctttgagcttggctttgtcgtcattcgctttgatgccgaacgtcttaacatctagcgcgactgtattgaagtcggtagaaacgaaagtatgcggatatccaagtttttcgagaccgcgaatgctgttaacgaacggtcccgtcaggtaaaactgcctggagaccttaagcagtttgcttaacgcaatgttgagctcgatgactcgttcgtcttgatgatcaatgtccccgcttttcagttgtcggaacgccaacttgtaaaactcgtcaatgacgaagaggtcaatgtcgacgatgtcgtcacgctcgttcactcgctcctgagttaacacataaacagcctgatcggaatggcacacttgggaactgtggtggatgatctgatatcggtcaccgaatcgctcttgcagtcggcgacgggtttcgtcggcaagagccacggttggaacaaccagaacaagccgtttcaaagttcccatgccgagcaatgaatcgacgattgcacttttgcccatgcttgtaggtgcactcagcaccacgttttgaccagacttgagcagatcgaatatgtggaactgcattgagtggaaaacataaccatccgagaatggcgtccggtatagctcaagcaccctcaggtcatccggtgtcaggctggtgaactcctttttgagatacgggaacaaacctgattttctcaccatatttttcaaaattgtggtgtgctcggaaaaccgctcgcgcgaatcgagagctcgcacgatcaagtcccgtcccaagtcatacgaaacagggttagacaacagcttgttaaccgcaaacagataattgaacgatgagaagtcctcaccctgcaggctatgtttcgcctgttcatagatctctgtcatacgacctctctcaccttctcatcaactaattgggttaaccgctcaagactcggggctggataaatgaatacgtggatgcaaagattcgcaaacggcgaatcctcgatgaggtcagccgcgaatttttcgaacagcaccgctgtttctttctccaggtcatcctcgaaccccggcgtttcaggctcggttagtagattagagtcgtagcccacgaacagaacaaacgtgaaacgatcgaggtgagcatcgaaaggttggctgccatcaagaatttcgtcaatgtcgtggcgaagcaggtagttatcgtctttaatgtcgaggatttttttgcgcgcggtatcgatgcaatccgaaatgtcctcgtacaactgatcccgtatctccggcaatctgacggcaatgttaatatcagtcaccaactcgctgaagccaatccaaagctgatcaccttctggatcgcggcgaacgatatgcacgttttcaagaattttttcggcccctgctttttccacgtatagcatgcaaggaataggctggctttcgtggtgctgccggatcgttgcgtgcaacagcactcgacccaaaaattcgctgacgtcatggagcgatttgaagacggaattctttagtcgttctcgcttttcaatgaatgtcagtttatgaatatcagacatttcttttggtcggagaaaaacctcatccaaccattgacagacgttatccgcgatgtgcttgtagcggtatttcttaagtgagtactgctgatgtagaacctggcctttacgcttagcgcagaccgaagccataggcgctctaaatggcgtaaggatgtggggtaagtcccgtttgacgtagattttgcggcctgaccgagattggtcatcttcgacacgctgcttgaaccactcaagtaggtctggtcgtaagtaggacttgtcatcagcactgtgaatgcgtcgagaatgctcgcccttgcgcgtcacagtatcaaggatgcggcaccaaatgtcttcggcgacggtttcggaactgagaatgaccccatgtagatcttgggaggccagccgtatgttcttgatccctagaagttccagttcgcgcagggatgaaaacacttcccatgtagccgcatcgatccaatctgaaacgcttatacctgagtctgttaaaaaattgtctgtgcgtttgttgaggtcatcgatgagttcctgtcgacctggcttatctagtcgggcgtttgggctgatcgtcaagtactcaagggttttgttgaccttttcctctgtgacgatggagtacctacgtccaagggacaggtcagactcacactgcattgatttgtgcaaaattgaactgcaggggatcgtctttttatcagcaccttttgaattctgaacgatgtccgaaatgttccaacgtgttttgccggtgctttttacctgaacgaagtcgatgtatccatcagatacaatgtcgatatcgtctgtgacctcgcagcgcacactgcggatagtcttgtcacgaagcattcgggtgacatggtaagcggctacgcagtcctgaaataagaaaccgtgcttggcggctactccgcctgaatcgttcgactccatttagacatccgtgacaattttgcgaaaattaaggagatgttatgacacagtccaatcggatcactgcatcatcaccagtgatctaaatacttcacagccattctcggtcgcaggtatcaagcttttcaggattccacaaatattgtaaccctgacgtctaatttggttatataacatactgccccaactaacgtaaggtaggcacagccttaatcaaggttttggttttcaaatagttcagagctgagaccgccaaccgcactatggcactatggcactatggcactatggcactatggcactatggcaccgccagcgattgtaatcacacttgatattataaaacacagttgcacgcattatttcctggttggtagggtcatatctcgatgctctttgagcaatgtcaacatcgcgtgttcatggctttctatattgttgatgccttgcccatccggaccccactccttatagctcatcatgatggcttgttttgggctctctgctcgttctgtttcgacgtagaattttttcttgtctgctggcgaataattactaagtatcgagttgctgcttggtgagatcaggaagaggttaccgaaacgatggacatcatcccccattttgtggactgcccccccggtagacgatcctgccctatagttggagtgccccctattcaggtggctaaatttagcaaatcaatacacttcaggggggtattattgtagagtttccccatatgtttctatgggatccaggaaatgacaatcaggagttacaaaaacttaaatctggtcagggcaaatatcgagactgaatccagacaattcattgaaaataaaaactattcaatccaatcaattggtcctatgccagggtcaagggctgggcttcgggtcgtatttaccagaccaggggttaacttggcaactgtggacattttttataacggggacggttcgactacaattcaatatctcactggagccaatcgttctctgggccaagagttagcggatcatctttttgaaaccatcaatcctgctgaatttgagcaggtaaatatggtactgcaaggatttgtagagacaagcgttctacctgtacttgagctatcagcagatgaatcgcatatagagttcagagaacactctcgtaacgctcataccgtagtgtggaaaattatttccaccagctatcaggacgaattgactgtgagcctgcatatcacaacaggtaagctccagattcagggccgaccgctgtcatgttacagagttttcacgtttaacttggcagccctgcttgatttacagggtttggagaaagtgctaatccgccaggaggatggtaaagctaatattgttcaacaggaggttgcccgcacttacttgcagactgtaatggccgatgcttacccgcatctccacgtgactgccgaaaaattgctcgtttcagggctatgtgttaaactcgccgcccctgatttgcctgactactgtatgttactttatcctgaactacgcaccattgaaggtgtcttaaaaagtaagatgagtgggttaggcatgccagtacagcagccggcaggttttggaacttactttgataaacctgctgctcattacattctgaaaccgcaatttgcagctactcttagaccggaacagattaacatcatcagcacagcctatactttttttaatgtggaacgtcattctctgttccacatggaaactgtggtcgatgccagccgtatgatttctgatatggcccggttgatgggtaaagccactagagcgtggggaataatcaaggacttatatattgtttgaaatcaccggaattaacgtctcaggggctctaaaagctgtcgttatggcgaccggcttcgagaaccctttgtcctcagttaatgaaattgagacgaaactttctgccctactgggtagtgagaccactggtgaaatcctttttgacctcttgtgcgctaacggtccagagtggaaccgcttcgttacgctggaaatgaaatatggccggatcatgctggatacggccaaaattattgatgagcaggacgttccgacacatatcctgagcaaactgacttttactttacgtaatcatcctgagtacctagaagcctctgttttgtctcccgatgatgtacgccaagtcctgtcaatggatttttgaaactcttctttctaaacgaaccagtatagaattcgcccttttggcatgatattaacttgtccaatatgatcaaatagcattaaccccccctcacaacgtcctgcatagggaacacgttttcccctgtgcacccacgactaaatttccccccctttaaacttctcaataatgtcaccaattttctggaaatcctatgatgcctttcccggtaaatggtgctgtgagttcagaaagattctgcaatctatgtgcattgaaaaaatcttcagatagatatcattctcctgaacaatccgatgaacggcagaacctcgcggttctgccgtttttgttttacttttcagaggagtggtgatgaaaaattttgaagttctgcagccactacagaactccctttccggtctaccgctatgggtatctgaacgtatattgcagcagataaatcagttaacccactacgagccagtgatcggcatcatgggtaaaactggggcgggaaagagtagcctttgcaatgccctgtttgccggtgaagtatcgccggtcagcgatgtagcggcctgtacacgtgatcctttacgctttcgcctgcagattggagaacactttatgaccatcgtggatctgcccggcgtgggcgaaagtggcgttcgcgataccgagtatgctgcgctgtaccgcgaacaacttccccggctcgacctgattctgtggctgattaaggctgatgatcgggcactggcgactgatgagcatttttaccgtcaggtgattggcgaagcataccggcataagatgctgtttgttatcagccagtcagacaaagctgaacccaccagcggtggaaatatcctttccacagagcagaaacaaaatatcagccgcaaaatctgcctgctgcatgagctattccagcccgtgcatccggtgtgtgccgtgtcggttcgcctgcagtggggactaagggtgatggcagagcggatgattaagtgtctgccgcgtgaggccagcagcccggtagtagcgctactgcaacatccctttcgaacaacggtagcccgggagcaggcacgtgacgatttcggtgaaaccgtaggtgccatactcgatacggtaagcacctttccccttattcccgccccggtgcggaccattattcaggccgtgcgttcctcggtggtgtcagtggcccgcgctgtctgggatttcttcttctgagtgtttaattctgccctattattctccgagccctgtcgcaagtgcggcagggctttctttatttgttttacccatactgaggagtctgcttatgacccgtctggcttcgcgctttggcgctgcaaatcttattcgccgtgaccgtccgttaacccgtgaagagttatttcgcgtggtgcccagcgtattcagtgaggataaacacgaatcccgcagtgaacgctacacgtatatacccacaatttccctgctggacagcctgcagcgggaaggcttccagccattctttgcctgtcagacacgggtacgtgacccccgtcgtcgtgagcatactaagcatatgctgcgcctacgtcgggaggggcaaattaccggtaaacaggttccggaaattatcctgcttaactctcacgatggcaccagttcgtaccagatgctgccgggcatgttcagggcggtgtgccagaacggtctggtctgcggcgagtcgtttggcgaggtgcgggtgccacacaagggggatgtggtgagtcaggttattgagggggcgtatgaagtgctggggatttttgagcgtgtggaagaaaagagggatgccatgcagtcgttgcttttaccgccacctgtgcagcaggcactggcaaaagcagcgcttacgtatcgctttggtgaggaccaccagccggttactgaatcgcagatactctccccacgccgctggcaggatgagagcaatgacctttggaccacctatcagcggattcaagaaaacctgattaagggcggactcagtgggcgtaatgctaaaggcggacgaactcatactcgtgccgtgcgtggcattgacggggatgtgaagcttaaccgtgcgctgtgggtgatggcagaaacactgctcacgcaactgcagtagacgtttcatgttgccacgttgttaatatcggacaccacctgtccgcatcgctatgtgctcgtgtgcctcaatcccccggttatagcttttaacccccgttacatctggcttttgcagaaataaaaaatagtttctgcgttgtccataccctgtccgcccccctctttaaagtaatcacatcattttcagtcagttaactttcctggagaatctctcatgacacaggcagaacgccgccatgaccggctggctgtcaggctgtcactgataatcagccgtctggttgcgggtgaaacgttgagcgtgcgcaaactggcggctgagtttggcgtgtcagtgcgcacgctgcggcgtgattttcgtgaacgactgatgtatctggacctggagtatcagtccggatactgccgcttacgcactgctggcagtgagatgcagatggtgcccgacgtgcttatctttgcccaccgcagcgggctggccgggctttttcccggccttgaccgccgtctggtgaatgcactgctgatgtgcgatgagtctccctgcgtgatagcaccagccaatccggttccttcgccttcaggagcattgtctttctggagactgattcaggccattaccgggcgcaggcgggtgacgctgattgcagaggggcgacgctgtgagcgcctagctccctgccggttactcatccaccagcagacctggtatctggtggctgaacacgaagggcatatcgccgtattcacacttgatgaaatccatctgattcagcctttgcaggagacttttcgccgcaatgacagtctgtgtcgcctggttgaagacccggtcttcattcaggccttaccccattttcgctttatccagcattcactgcttacgtttgttccggccgacagcccaccggaatagcgcaggcgttgttatcaacccggcaacatggaggagcccagtgcccgttattgccattatcgccattgttatcatcgtcatcattctgaacaaaaccggagtgtccgacagcctcacggccctgacacttgcaaccgttgccgcactactgacgggaggtggtgcagccggtgctgccagtgtcgcgctgacgccgttcgtcggcgtgccggtgggtatttttgtgggaatttatgtctttgccaaagtggttcgtctgatttcagggaaaaaataatgaaacgtaaaacactacctctgctggcgctggttgccacctctctgtttctgagcgcctgcgatgacaggagtgatgacctcaaagctatcagtaaatttaaggacctcacgcccccgcgcttcagcgatgtggtcagccgtcaggatgatgtcagcgaagaatggtcacaggttggcttctcatccggtctcaccctgcaggtcttacgtacccgtgagtcgcccgatggttgcgagggtggcagttactactatctggtagatatggaggagaaaaccgtccagccgctgatgaatgcgctttgtattgccgacaatatcaaactggaataccacgaagttacggacccgtatacgaaagaaaaatacttcgaatattcccatgacggcaaactgatgggacggctgctgataccgtcaaaccctgataaccgggaataaaaacaacgagaaaggagacataaatgaaaatacgttcactaagccggtttgtactggcaagtacaatgttcgccagctttacagcctctgcggtccccggactctggcaacaggggtacggtcagggcaatgcggaatacagtgtgacggatgccagcggaaagatgtttaccatcaactgcacgggaaatccggaccagaacggtatttaccagcactcggtttttctgatcctcgccggggataaaacggtcagctcgcatgatgacagtaccggcatcacagtggtgatggaccataagcaatatgccattccctcaacccttggctggcgtaacggagataatgcctggttcagcttcatcatggatatccgtaaggcccggcagttcgacgtctacgtcaatgaccagaaagttggatcgtttaaccctgatgttcggaatgcacaaaaggtcctgccaacattagcggactgcactaacgactgacggctgcgccttccctaccataacaaccctgattgcctccggcggtcgggggtttcttttttctccttaatctccagaggtaggccacgtactttcgaacgatgagcgcagtggtcagtttttttcagatatatttatctttttttggctgtaagctccgctgtgagcgcaggctgtgttaaaactcctgatcactttttggtctaagcgatggtttcatatgatcaaccattcttgataaacccatgagacggactaactttttcattaaaattaaaaagatatgaatgaatactgcggatatcaacatggccaatcacattcaaggacaaggcaggcatcaggtgacattgctccctgatgcactcgatgattttgtcactgaagatatctgaaataagtttaatcagttcatcacgggtcggtggcatatcgagataattaattattgtcggttcgttgccgttgttatgaagcatctccagcgtgttgcgtgaggtgccacaggccgggttgtgatagatggtaatgttgctcatatcagtatctaattacaaagtgacagagagccgccacgccagcgcggccagagtgacaaacagcaccggcacagtcatgacaatgccggtacggaagtaatatccccaagtgattgtcatatttttctgggcaagcacatgcagccacagcagagttgccagactgccaatcggggtgattttcgggcctaaatcacagccaatcacattggcataaatcattgcctctttgacgacgccagtcgccgtactcccgtcaatcgacagcgcaccaatcagcaccgtcggcatattgttcatcactgatgagagaaatgccgtcaagaagccggtgccgaacgtcgctgcccataaccccttgtctgccagcagattcagcacgccagacaggtactccgtgaaccctgcattgcgcaggccatagaccacgatgtacatgcccagtgagaaaataacgatctgccatggcgcaccgcgcaggacttttccggtgttgatcgaatgacctcttttcgccaccacaaacagcactgctgcgccagcggccgctatcgcactgaccaggattccctgcggctccagaaagaagaaaccgacaagcagcaataacaggacaatccagcccgccctgaaggttgccagatccttgatcgcactggcaggcgtcttcagcagcgaaacttaatacgttgccggaataactctgcgaaagaagagatacagcataatcagcgtggccgcaatcgctgccgcatccacggagatcataacggaggcgtactgcgcaaagctcagaccgaagaagtccgccgagacgatattcaccaggttagaaacaatgagcggcaggctggccgtatctgcaataaatcctgcagccatgacaaaggccagtgtcgtgccctggctgaacccagtgcgatcagcatcgcaatcacaatcggcgtcaggatcagcgcggcgccgtcattggcaaacaacgcatcaacagcggcaccgagcaagactttccaggtgaacagcgctctaggtaggaactttgtcgttgatagagtcttcagccatcaacactgtatcgagtaatgaaattggttgctagaaagtcgatgatttgttgcgtatgattaaaaatcaaccttaaaggctttatacatggatttgctatggcttttgtatcagaaagagaaattgtaagaaagatatttagcaaaaaaattgactttacgatcttggcatttttctatatttcctctattttttttcttctttgtagtggcgttctctttcaatattttaccgctgccttcacaaaaggtaattgttatgaatgctcaatgaaacttgattacataaaacaattttatttttcactggaaaccgcatggtacctcatatctgctgttgcagtatttattgcatctgtttttatacagcatagaattaaagcttatttaacattattagctattacatggattgtactaacaataacagatgtggcgttaatacacgccttagacaatatagccatgaataatattttgttaaatatactatataatctttttggggcgattttattgtcactgtttatgtgtttatcaaattccctccttttccaccttaataagataaaacatattccaatgattttatcggcaatgattccattagtttccgcaataataatagccatactcataaccgctgttatatatttattgtttgcccggcaggcggtagagattgagatggatatatctgaaggttcagacatcgcatatgtaggtgtaaaagataatgaggaatcatttgggtttttaaatgataaaaaaacagacacaccaacgtatctggatgtaatcaaaaatggtagtttgatatataatgatacacagggtttaagtggtgctgatatttatattgtctccggttgttatgcccttccagatttacttcgcaatgtaccgcttgatgctaaaaaatcttttctgaatgtaaaaaagctagaaatcacacagaaacttccaatgatggggttcatacaaggtgaatccgctgatgtgatgcctaaagcagcatccaggttaagtttgagcaagcaagatgataaatttatgctagcctcaagtgttactgactctcaaataaaatttaaatcaaacaatgcacaattgatggttgctttcgcatttatgccaataacaacgaatggtattttacatgattatacatacgatataataataaatgataaaaaatataaaattgaaaatcatgttgcacctctatctaggcttgataaaaataagaagatgaagtgtgaataccagcaaatatcggatttaacaaatacgtataacattaatgcaaattacttaacgggttttttacttgtcctaaaaccagatgatattattaattacaacaatagcccttccgtactactcaagactgattttgcgttctataaaaaaacataccagaagcttgataaaatatatgatgacataagcaatggaaaattatcttcactgagagcaacaggtatctcccagtttagtatcaacgggaaacatttgtcgttaaggccagaatcggagattattatttctgaagggagtttgtatggactagttaataaaagcaaaaaaatcaaaatatatggcacagcagatcttgtttttgttgataacaagataatgaaccttcgtaaaataacttatttgcaatctaagctagaaatttttggttcttctattatggatatattaaagtatatatttggtttaggtctgctagcaatttctataaaattcattcattcttactttaagaatgatgtgaatgaaaatttattcttgtaacgcatttggctccaattggagcctttttatgactatttattaaaatatcctaagttaagcctgtttttaaagcaggcttgagcgtgaagcggacactcatacctgctttaaagtggcgtttttgtcgttacccatacctatattttctgttgtttaactgccagaactgagcggttgaaaagccagaaatatgccgagccagcggcatggaagcgccagcagctgttgaatggagtactgtaggcaaatggtgccgtaaccggctttcgtactgaaaggttctgtctatcccatcccttctcttgtatctaacatttagttgtgaatagctactgtaaatgcccctacaaaatgaaccattatttttagagggcgtctggcactccaacttccgcttttggcacagaacggcctatcagcaatataaaagcattcagatatatatcatttctacaaacatacccgattaacggcagaatctcaggattctgccgcttttttattatttttcaggggagtagtaatgagcaactctgaaggttggtagtcattttagcaaacgctttctggtctgccgcagtgggcatcggctgattgcgtagcagggccactggtatctgccggtatcaccgacattaacattgaagacgaccagggcattcacgtccgcctgatagttcgtgatgccgaaggtcggatggttggcgggcatggaactttgaaccggacgccggtgaaggttttaaccgctatatccacaggtcaggcatccgcaccgacaccttcccccgctgactccgaatcatttaccagcaacatttcaccttcccaaacgcgctttattacctcatacgccagccatcgccgctggcgttttttattcacggagacatacccatgacaacacagacacagtacgacctcgtacccgctaacggatccgaatttgagttgagcgtaacgcaggtacccgatgaacagcatatccgcttctggccgcagcactttggcaccatcccgcagtggataacgctggaaccgcgcattttcgcctggatggaccgcttctgtgatgagtactgcgggggtatctggtccttttacacgctcagcaatggcggagcgtttatggctcctgatgctgacggtgacgataaatggcatttgctcaacggcatgaatggcaatggtgcggaaatgagcgcggaagccgcaggtatcgctgtctgcctgattgaatatagccatcacgcctgcctcaccgaatgcgatgccatgacggagcactattaccgcctgcgggattacgctctgcagcaccctgaatccagcgccattatgcgcattattgattaaggatactcatgatggaacagtcactcatcccacagacaccggtacttccactgaccgcacaacgcacggtaaaacgcgccttaacgctgcttgaccgacacctgcgcgaaacaggcgtggcattcacctccactcaggctgctcgtgactggctgaagctgaaaatggcggggctggagcgtgaagaatttatgatgctgtatctgaaccagcagaaccagttgattgcccacgaaaccctgtttgccggttctattagcagtaccgaggtacatccccgtgaggtggtcaaacgcgccctgtatttcaatgcagcagcagtgatactggcgcataaccacccctccggcgacactactcccagccaggcagataagactataacgcagcgtctggtgcaggcgcttcagctcgttgatatccgtgtccctgaccatctgattgttggtggcaggcaaatctattcgttcgcagaacacggtctgctttgaggtattacatgagaattatcagtaaacgccgggcaatgacgatataccgccagcatcctgagtcccgaatctttcgctactgcaccggaaaatatcagtggcacggtagcgtctgtcattacaccggcagggatgttccggatatcacaggagtcctggctgtgtacgccgaacgccgcaggaccgcagcggaccgtatgcttgactgatgagtatcaccctgaactgacaataaagaggttatgaatgagcaacaccacatggggcctgcagcgagatatcacgccgcgcctgggagcacgtctggtgcaggagggcaaccagctgcactatctggctgaccgggccagtatcaccggtaagtttagtgacgccgaatgtcctaagctggatgtggtatttccacattttatcagccagatagagtcgatgctgaccactggtgaactgaatccccgccatgcccaatgcgtcaccctgtaccacaacggttttacctgcgaagccgatactcttggtagttgcggctacgtatacatcgctgtttaccccactcaacgctaactaatttcacgagagcaagcatgaacactctacctgctacaatttcgcaggcggcgaagccctgcctgtcgccagtggctgtctggcaaatgctactgacacgcctgctggaacaacactatggcctgacactgaacgacacgccgttcagtgatgaaactgttattaaggaacatatcgatgctggtatcactctggccgatgcagtcaattttctggtggaaaagtacgaactggtacgtatcgatcacagaggattttcgtggcaacaacagtctccatatatttccgtagtagatattctgcgagcaaggcgctctaccggcttgctaaaaactaatgtgaaataaacgcttaaatacagagcagactgaaggaaagcaaaatgctaatctcatagacgaagagactcccgctgtaacctcccctcccccgaaaaaacctgacattttcttttaggaccaacaatgggaccaaaatgaaaattgaactgaagattacaatcaatttaacaacaagttacacaaccaattcagactccgccagcccaccaatcatgattggacggtgtaaggacaacaccaacaaaaacaggaagttagaagtctcagcaaaacaccgaccagacggtgaggagacataaaaggatacgcaaaggagccgcggctcctggtaacatgaaagcccacagatgtgggctttttcgttgatggtcagaacgaccagttcacaccagctaccgcgttccacggggattccacaccggcactatggctataccccaccccaagatgcccgcttaacgtactgctgaatgaggctttaatacctgcctggtatattccacgtctgcccgacaaataattgacgaaattaccgtcactattcactttcacccggttatcatcgacaaattctttgcgcacagccgccttcagccacggctcaacttccataccgttccccagacgcatgttgtaactcagcgttgcgcccagttcacgatatatactgcgggtatcgactgatttcgatttcatgccattggataaatgatattcggggttatcagcggtgaaccccgttaacgatgcatacggcgtcaggttccagttaccatcggtaaatcgcatcccggtttcaatgtgaccgcccagcccgttgctgtggtaactgccattggcggctccaccgctgctcattttacctgctacgttacttttaaaacggttcagcttcacgacaccgtccagatagaaaccactttcatgttcccaactggcatagccgcccagagaataactgcccacactgccatgtcctccgcgatcaaaaccgatatgtgaatgggaatagcccataaaagcgcctagcgtggtaattccttcaggaatatcattacggctgtcgatccccactgtcattccggtcagcgtctgctcaaacccggcacccgcatcggtggtgacattattacgggtgttatacgtcgccccccagacattattgttgtgtggactcgctttcattatgttcaaccgctcgcgaatactgtttagctcagcatcaaataccaacggtaatgttgctgccatattgagtacggctgccgtagaaggcgtaatgcgtttctccggaacgggtgtcggcgttggatcgggagtagggtctggttttggatttgggtctggctttggatcgggttttgggtctggctttggatttgggatggggtccgggttgggtttgacatcattggtcaggttccagttgctgttgccgtcacttttcaggacatactcataggtcccaagatcaacgaaaccgccggtattgcccagcgtaaacgaagcatcccctccccctgttttcaccagcgtcatcgcgtcgtcagactgtgggctgacgccggtatcctgaacaaagattttaaaattaccagtggcgttgttgttgacgaccagttgatcgccccgggagcctgcaacgttggtatgcaggtagaaattaccgctaccggaaagttcattggttgtcagcgtattgtagataccgttagttgtggcaggcgctgctgtttgtgctgacaaataaacatcaccgtcgttgagtagcaaactgtttactctatattcgcagttgctggtacctgcacaggaattattgctgttaagccagacactgccccggctggcagccgtcaggtcggcaagcgtggtatcgacgccatttcccagagtcaatgtcgcgctatcggtaatccggaccgccccttcgagtttaactggcgtaacattatcccgtggcgtcattaacgacaggcttcctgtcgcgccactgaccgatgcatccgccagcgtacctgcgtagacgattgccgtaccgccagcgacctggagatcttctgcccgggccagagcctgaaactcatcttttgaccgcccaagggtatattgcccgccagagttaacctttgtggcggagtcctgacccaggttttgcattgccccacccttgccaaccgtggagtcgcgagcttcggtacctgctaataccaataaattaccgccattttccagcaacatattggtcgctaaattgccggaaatggaaaaagtaccgtactggtgagtaccgctgatttcaataccgttagccgtgctcgtctggagagcggcaccgctgttctggacgatatctgtcgctttgccattatcgttgactgtcagcgtaccgccttcattgatctttgtttttattgcctctccgttagctgaaactgtttgtattccgccgtcgttaattgttgtctcattcgccacaccctcgacaatttgttcaccgccggtgagcgtcgtgcctgtcgcagtggcttttgttttgacgatctcccgtccgcccatattgacctgtgttttgtcagaagaggtgtctgactccacggttaacacgccgccatttgccagcaggatattgttcgccgcaccctgctcgatgctgaacgcgacgccatccgcgcgtgttcctgtgacccgcgtcgccctggtggttgcaaccaaagcgccctggctactctgctgtatccccgttgcgctgcctttctcccgcacatcgagtgtgccgccgtcattaagcaccgagttttcagccaggccgccctcattaactacctgtgaacccccattaataatggaaccttccgctgtcccgtttgccataatttgttgtaggccagagacgatatcggtattgattgccttaccataattctgaacggtttgcgtgccaccattgatgtgtgttttctctgttgacccaccatcaacaatttgttcaccactttcgatatttgcttcagtggctaaaccatataccgtttgcttgccacctttgatatttgctttatcagaagtggcactggcatatattgtttgggtgccagcactattgagtacagtgccaacatcttttccataaacatccattttgccgttggcattaataatcgtgtcaactgcgcgggaaccagtgacgactgttaatgagccagcgttttccagcactacatttttagcttctgaattcctgatgtagaaagcatcaccataactgttggttccttcgataagtgttccggaggtcgtggaagcaattaatgcgccgccggattgttgctcaacatgcttagcctcaccaccgtcctgaacctccagaacgccgccattattaagtctggtgctatctgttttagcctccttctggacaatcagcttaccgccagtatcaatggtagtatttttcgccgaggttttagccactaccgtcagttcgccggtattttccagcacaacataattagcctcccctccggtaatagtgaagtgagagagcttgttgtatccttcgatatcagtccctgcacccgtgttggcaactaaagcactgcccgtctcctggttaaccccatgtgcaataccgccggtatagacaatcagcgagcctccggcgctaatattgctgccaattgccgtaccatctttctcaacaacctgccggctcccggaggatataattgttgtgtcagctttcccgccgcttttgatattttgcgttccgctgttgatattggtgcctgtggctatgccataattattaatattctgtgtgccaccattaattatggtatttgtcgcgtttcctgcaacatccataaccccgccattatctattcgggtcgcatcagctttagcattggttaaaactgacattgttcctttatctttaataatcgtcttgtttgccgaaccatatgcgtttatgtctaaatgaccaccgttttccagcaacacattgtctgccacgtgattgtggatggagaatgcaccttcactattcgtaccgctcaccgtcgtaccgttagtgttagtttttaaaattgcaccatcgtgctgggtaacatttgttgccgtaccacccctaacatcaagcacgccaccagaataaacttcaataacatccgaggtgctggtgttatcaacaatttgcgtgccaccagaatagatatgcgtattttttgccgttgacttactattcagagactgagttccgccttcaatcgtcgtgtccagcgcacggctctcatatactctttgctcaccgccatttttaatggttgttgtttctactgtgctctgttcaacatactgtcgaccaccatttatggttgtgttcgttgccagacttccttgtactacgtcctgagagccagacttatttatcgttgtaccatcagcatgcccttgaacttttactatctggctaccaccatcaatgagtattccattcgcactccctccctctacgcgtgaagcaccgcccttaattgtcgttccattgctgataccccctttataaacgtcctgattgccactctcgattgtcgtacctgtggaaatacccccgtcatgaattgactgtctgccaccgttaatggttgtattattagcctgccccacaaaattgttatgacttcctatatcttgatatccaccagattcaataagacttccattagataccccgccatgaacattctgctggccatggttgataatatgagtgttatttgttgtacctcgttcatccactttttggttgccatctacagtctcatcgtttaccacaccaataacattagtagtgaaggcagccatcccgggcggggcatatatcaaggcagatatcaataaggaaagtactgagcggcgacaataatagggactggtcctgttcataaatttcatcctctgaaaagtgaatactgagtagcgtttaagcgaccttagctttgctgcaacatcagcccacaggcaccagaccaggggattcatcctgaagagacagcgcaagtgtattgtgttcaccgctcatcaaagacatcatgatgaaatgatgatattccgcataagaatgaggcattttttaaacgcagtgcgctgaagtgtggttggataaaaaagtcaatccattcaggaaatacgggcgtattcttttctttcgacaatgaggccgttggcaaaataaaatgatttacataatcgtttctgatgaatatcttctgctcacataaaaatcacacaataactttgagatcgcagattgttttacttttacagcattcgtccccccattgttgggcaaatatagattgggccagagcacgaaagttaataccacgttcgcacagctcctccaacagcacgacaagatgccacatactgcgccccagtcggttcagtttacagactagcagtgcgttccctgccgatgatgtcctgaccagttttttcagtccggacctcctgccacggttttacgttgaagtggtaaccctgagcacgcagttcttcagtcaggcgtggtgcaccgtaacgctgttattgctgggtaagatcaaaaaactttcaggcagctaaggaaagttgaaccagacattagatgaaatatttcaaccaattacagcaccaattcagtcactgccagcccaccaaataaatcaaggggttacatgaaaacgtagcccctttttctttggtagtgacactaaaatggatgtagtgtgaagaataatcccgtttactcaatcaataatacatattgtttcaatctacgttattatctctttgtaaaaattgccatttattaatcattgaaaactgcttttagaacttgatacaacgggactagtcacaacaggactattctcaacgggatcatcctcagaggaactatcatcaaagtcatcatccataaataaaatatcatcgaatggtgccacgcccgtgatgagttttattttattattacgatcagtcaatactccacttaaaccgttttcgctcacaggttttaatgatttttcattactcttgttgtaagcaggcgcattaaaaatacacggagtatcaacatcaaacaatgacgttccccagttcacatattgaatatcatagttactgaagttctgtccagaaaagaagcaccccttaaaatccaatccacgtaaattatataaaccaccctcttctttttggagagtaatgttaattttggctatctcccggacatcatcgccatttttgtatttgaataccgtttcaagatgttctccagacagcttgacttcaggaaataatttgaaatcaaagcctatattattatgtgtcaacgtagatgaacaaaaaatggaaaaagcttgcagtgctgaattatagctatcgattttatcttgaggctgagctcttggtaaaaacttatagcaacactcataaaaattaaacagaagctctgaagaccttgtatttttatcaaataatacccccttgaactcattcacaaacgcatcttttttttcttgaatatctatggggtgttcctttgactctgacaaagatgaaatctcatctattttgttttcatatgaattacgtgattccatacagacatttggcggcgtttctaaaataacactacgcgtactacttggcttaagtaaaccaacatgaaaatcactttttcttatattatcgaaaaggttctattcatttcttttagcgcattcaaaaaactgatcggcattatttttattcgataattttttagtttcagaaaacacattttcattgttttccagctttagtttaatgagaagattttcccagacctgcttgcttaaacatattacgtcaggctcaccagaactaactaactcgtgattattattaaagtgtacgttgaatacctttaagttattttcaccaacttcatatttaatacgttttaattgttctccagctcccataatgacaaaggcgttgccttcttgatatatacattcagacatcattttttgtaaagtttcaagagcaccgcgatacgtctctgatgcagcttccttacaaattaattttaaaatactatgagctagtagctccatgtgtttagaagatttattttcattataacttccactacccaaaactgcgctagcgttaaatccgttgcttttactaactaacattgtctattcctcaattaatgtctacatggctatttttaatgttattactgtttgtcactataaaaaaacgctcatttgagacaattactgacattaactgcttcacttgctacgcatggaacttttaattaaattagcacaggaatgttaaatttaataaacaaaaggttatttcgctgtatgataaaaaaaaccgttataatttattagtgaaaatcgtttttcaagtgttagaaatttatatctcaatagcgttggttaatgagcatagccacgctcctgtaacgctcacaaaactcatctgcctgcggcgggtgttctggtcagtagtagatgtttaaggcgtggcagagacatttcatccttactctacggcattgttctacatacattggttgtggtactcacttatcatcagtgagcgaacagagaatagttcagtgatttgagtaattaacctgattaaatgaaggggtataataaatgataatactctggctttatcgttaattacttaattccacatgtaagcaatttgcccgcttggcatagcaggcattttttccaggtacttttgaatgagtactgatggataaatacattgcagtggcgtgccacgtaccaaaacaccagccctcattcgaaaccacccaccgcacttcttccttgaaatggcgttagtcatgaaatatagaccgccatcgagtaccccttgtacccttaactcttcctgatacgtaaataatgatttggtggcccttgctggacttgaaccagcgaccaagcgattatgagtcgcctgctctaaccactgagctaaagggccttgagtgtgcaataacaatacttataaaccacgcaataaacatgatgatcatatgatgtaaataacagatttttatgcgttcccattcaccttgggtcgtgattacacgcgacataaaacccgacaccgcctccattcgcaaagtcgatactcgcagtcaacaagcaaatgttaataattagcactatctatagttatcatcgattcaatgatactttgtaatgattttgtatctaataatataactttattacattagctgaagagttttcgcatcattatgatatctgttacttttcactccataaaaataaacttcgtatagcaatatattctttcatagatcttattctgctaatcattagtttcgtatgagcgatttttgacagttgcctctccagaccacatcgataattaataaaacagatttaagcattatccttttccatataaatattggataaaagtaggacatctgtttgcaattactttcacaacaattaaacatttttatgtttccgtatacatcatattactctaccattagaggaactttattatgttttctataaaaccaggacccagaaatttacctatcgacaaccccacattgttatcatggaacattactgacggggatctaaattccaaattaaatacattagaatatctaaactgtataacaaatattattaattcttgtggagtttaccctcaaggattaaaagacagagaaattatatcaacttttcacgcagaaaaagttattaatgatctgttaaaaaacgattataaaatttccctttctccagatacaacttaccgagagttgaataaagcagcacagcgtagcattacagcgccagacaggataggagaaagaaaaacataggtttatcaacgagatacaatgattgaaagaggtgataacagcggtgtttatcagtatggtcgtgctgaacatttcacccacattatatctgacaaaccttccccaaaagataaatatgttgcatatgctattaacattcctgactatgagctggcagccgatgtatataatattaacgtgacgtcaccttccggacagcaagaaacatttaaaatattaatcaatctagaacatctacggcaaacacttgaacgtaaatctcttactgctgttcagaaatcacaatgtgaaatcatcacccccaaaaaacctggcgaagcgattcttcatgcttttaatgccacctaccagcagatcagagaaaatatgtctgaatttgcacgttgccattatgggtatatacaaatccctccagtgacaactttccgcgccgacggaccagaaactcccgaagaagaaaagggttactggtttcatgcttatcaacccgaagatctttgtaccatccataatccaatgggagatttgcaggattttattgcattggttaaagatgctaaaaaatttggtatcgatatcattcctgattatacctttaactttatgggaattgggggtagtggtaaaaatgacctggattatccctctgctgatatacgagcgaagatcagtaaagatatagaaggtggtatccctggctattagcaaggtcaggttttgattccattcattaaagatccagtaacaaaagaacgtaaacaaatccatccagaagatatacatctcactgcaaaagacttcgaagcaagtaaagataacatctctaaggatgaatgggaaaacctccatgcattaaaagaaaagcgtttaaatggaatgcctaaaacaacacccaaaagtgaccaggttattatgttgcaaaatcaatacgttcgtgaaatgcgaaaatatggcgtacgaggtttacgttatgatgcggcaaaacactcaaaacatgaacaaatagaaagatcaataaccccaccgcttaaaaattataatgagcggttacacaatactaacttatttaacccaaaatatcataaaaaagccgttatgaattacatggaatatctggtaacttgtcagttggatgaacaacaaatgtcatcactgctttatgaaagagatgatttaagcgccattgatttttcattgctcatgaaaacgataaaagccttttcatttggtggagatcttcaaacccttgcatcaaaaccgggttccacaatctcaagtatcccatcagaaagacggatattgattaacattaaccacgattttcctaacaatggtaatcttttcaatgactttctatttaaccatcaacaagatgaacaattagcaatggcatatatagccgctctgccgttcagcaggcctttagtttactgggatggccaagtattaaaatcaacgactgaaattaaaaattatgatgggtccacgcgtgtcggcggtgaggcgtagcttaataaaggttgctctacctatcagcagctctacaatgaattccacgcattatatatagataaagcaggaatatggagcgcatttgagggtgtatctgcaactaaaaacgttctggcctttagtcgtggggattctgtgaacattaatcactctcctcatgatggactagttataataaataaaggaaacgaagaagttgaaggtacctggcctaacaaattgcaacctggaatatacaaaaacatggggagtaatagcgttaacattattattaataatacccgaaaaattatcccccctggtaaagtatttacgcttagaggcggaactctaaatatcaatattcctgggcgtagcgctcttcttttagggaaaacaggagaaccgccgaactatctctatttataatttaatgttatatctgccccgataaaacggggcagataatatgtttagtttactaacggtcattttgcagtgaagccatttactgttttttatcgaccagataatctgttctctaatgttaactccccctaacctgttgctttagttattcatttcctgtctcactttgccttaataccctacgttaaatgttactaatttgttgcttttgatcacaataagaaaacaatatgtcgcttttgtgcgcatttttcagaaatgtagatatttttagattatggctacgaaatgagcatcgccatgtcaccctacatctcataagaggatcgcttctgatgaatgcactgaccgccgtacaaaataacgctgtcgattcaggccaggactatagcggattcaccctcaccccgtcggcgcaatccccgcgtctgctggaactcaccttcaccgaacagacgaccaaacagtttcttgagcaggttgccgagtggcccgtgcaggcgctggagtacaaatcgtttctgcgttttcgggtagccaaaattcttgacgatctatgtgcgaaccagctgcaaccattgctgttgaagacgttgctaaaccgcgctgaaggtgcgttgttgatcaatgcggtgggtgtcgatgatgtgaagcaagcggatgagatggtgaagctggcgacggcggtggcgcatctgattggccgttccaatttcgatgcgatgagcggtcagtattacgcgcgttttgtagtgaaaaatgtcgataactcagacagctatctgcgccagccgcaccgcgtgatggagctacacaacgacggcacgtatgtcgaagagataaccgattacgtgctgatgatgaaaatcgacgagcaaaacatgcagggcggaaattcgctgctgctgcatctcgatgactgggaacatctcgacaactatttccgccacccgctggcgcgtcgcccgatgcgctttgccgcgccgccgagtaaaaacgtcagcaaagatgtttttcatccggtgttcgacgtcgatcaacagggtcgcccggtgatgcgctatatcgaccagttcgtccagccgaaagacttcgaagaaggcgtgtggttgagcgagctttccgacgccattgaaaccagcaaaggcattctttctgtgcccgttcccgttggcaaattcctgttgattaacaacctgttctggctgcacggtcgcgaccgctttactccgcacccggatctgcgccgtgaactgatgcgccagcgtggctatttcgcttacgcctctaaccactaccagacgcatcagtaagcgcaaaggaattgagcggatgtatgattttgtgattattggcggcggcatcatcggcatgtcgaccgccatgcaactgattgatgtctatccggacgcccgcattgcgttgctggaaaaagagtccgccccggcctgtcaccagacgggccacaacagcggcgtgatccatgccggggtctattacacgcccggcagcctgaaggcgcagttttgcctggcgggaaaccgcgccaccaaagccttttgcgatcaaaacggcattcgctacgacaactgcggcaagatgctggttgccacgtccgatctcgaaatggaacggatgcgcgccttatgggaacgcacagcggcgaacggtatcgagcgcgaatggcttaacgccgacgaactgcgcgagcgcgaaccgaatatcaccgggctcggcggcatttttgtgccgtccagcggcattgtcagctaccgcgacgtgacggcggcgatggcaaaaatcttccagtccagaggcggtgaaattatctataacgccgaagtcagcgggcttaatgagcataaaaacggcgtggtgatacgtacccgtcagggcggcgaatatgaagcatcaacgctgattagctgttccgggctgatggctgaccggctggtgaaaatgctcggactcgaaccgggctttatcatctgcccgttccgtggcgagtatttccgccttgcgccggagcataaccagattgttaaccacctgatttaccccattcccgacccggcaatgccgtttttgggcgttcatctcacccgcatgatcgacggcagcgtgaccgtcgggccaaacgcggtgctggctttcaaacgcgaaggctatcgcaagcgcgacttctcatttagcgacacgctggagattttgggctcgtcggggattcgccgggtgctgcaaaaccatctacgctcaggactgggcgagatgaaaaactcgctgtgcaaaagcggctatctgcggctggtgcaaaagtattgtccccggctttcgttaagcgatctccagccctggcccgccggtgtgcgggcgcaggcggtatcgccggacggcaagctgattgacgattttctgtttgtcaccaccccgcgcacgatccacacctgcaatgcgccctccccggcagcgacatcagcaattcctattggtgcgcatattgtcagcaaggtacaaacgctgttggcaagccagagtaaccccggacgcacgctgcgagcggcacgtagtgtggatgccttacacgccgcatttaatcaataacctttgaaaacaggatgtagcgatgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaactggagaatgcgaatgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtggtggccgcggtggaagcgcagttgaaaaaactgtcgcacacctgcttccaggtgctggcttacgagccgtatctggagctgtgcgagattatgaatcagaaggtgccgggcgatttcgccaagaaaacgctgctggttacgaccggttccgaagcggtggaaaacgcggtaaaaatcgcccgcgccgccaccaaacgtagcggcaccatcgcttttagcggcgcgtatcacgggcgcacgcattacacgctggcgctgaccggcaaggtgaatccgtactctgcgggcatggggctgatgccgggtcatgtttatcgcgcgctttatccttgcccgctgcacggcataagcgaggatgacgctatcgccagcatccaccggatcttcaaaaatgatgccgcgccggaagatatcgccgccatcgtgattgagccggttcagggcgaaggcggtttctacgcctcgtcgccagcctttatgcagcgtttacgcgctctgtgtgacgagcacgggatcatgctgattgccgatgaagtgcagagcggcgcggggcgtaccggcacgctgtttgcgatggagcagatgggcgttgcgccggatcttaccacctttgcgaaatcgatcgcgggcggcttcccgctggcgggcgtcaccgggcgcgcggaagtaatggatgccgtcgctccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattgctggcgatagccgaaaaacacccggagatcggcgacgtacgcgggctgggggcgatgatcgccattgagctgtttgaagacggcgatcacaacaagccggacgccaaactcaccgccgagatcgtggctcgcgcccgcgataaaggcctgattcttctctcctgcggcccgtattacaacgtgctgcgcatccttgtaccgctcaccattgaagacgctcagatccgtcagggtctggagatcatcagccagtgttttgatgaggcgaagcagtagcgccgctcctatgccggaggcgacgctgcgcgtcttgtccggcctacggggatccaggtcggataaggcgtttacgccgcatccgacaatctgtacgtgaacaggaagaaatctatgttggccgggtaaggcggagccgctctccggcaaaaagaatcaataacaattatacgcgtgacccggcgcgggaaatgtcggggcgctctcccaagtgacacactttcgagaggattcaggatggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccgggctactggtggttatgattatgcggatgttggcggaaatggcggttgccacgcccgataccggttcgttttccacctatgccgataaagccattggtcgctgggcgggctataccatcggctggttgtactggtggttttgggtactggttatcccgctggaagccaacatcgccgccatgatcctgcactcatgggttccaggcattcccatctggttattttccctcgtcattaccctcgccttaactggcagtaacttattaagcgttaaaaactacggcgaatttgagttctggctggcgctgtgcaaagtcatcgctatcctggcctttattttccttggtgcagtcgcaattagcggtttttacccgtatgccgaagtgagcgggatctcaagattgtgggatagcggcggctttatgcccaacggtttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatttctatcttctatttatgttctatttttgtcgtcgtggcattaattccgtggaatatgcccggactaaaagccgtcggttcttatcgctcggtactggaattgctcaatattccccatgcgaaattaatcatggactgcgtgatattactttccgtaaccagttgcctgaactcggcgctgtataccgcgtcaaggatgctctactccttaagtcgtcgcggtgatgctcccgcggtaatgggtaaaatcaaccgcagtaaaaccccgtacgtggcggtgttactctccaccggcgcggcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggctttatccgtggctcacctggctagtcatcggctttattacctttgtgttggtagtgatgctattccgtccggcgcaacagttagaagtgatctccaccggcttattagcgatagggattatctgtaccgtgccaattatggctcgctggaaaaagctggtattgtggcaaaaaacacccgttcataatacgcgctgatcatgatcaggagtcacaccatgaccattacgtctctggatggctatcgctggctgaagaacgatattattcgcggtaattttcaaccggatgaaaaattacgaatgagtttgctgacatcgcgttatgcacttggcgttgggccgttacgggaagctctttcgcaactggtggcggaacggctggtcacggtggtgaatcaaaaagggtatcgggtggcgtctatgtcagagcaggagctgctcgatattttcgacgcccgcgccaatatggaagcgatgttagtgagtctggcgattgcccgcggtggcgatgagtgggaggcagacgttctcgcaaaagcgcatctgctgagtaagcttgaggcctgtgacgccagcgagaaaatgcttgatgagtgggatctgcgtcatcaggcgtttcatacggcaattgtggcgggctgtggttctcactatttgctgcaaatgcgtgaacggttgtttgatctggcggcgcgttatcgatttatctggctgcggcgaacggtgctttcggtggaaatgctggaggataaacacgatcagcaccagaccctgactgcggcggtactggcgcgagataccgcgcgcgccagtgagttaatgcgccagcatttactgacgccaattcccattatccagcaggcgatggctggcaattaactactcttccggaatacgcaacacttgccccggataaattttatccgggctttttagcatcggtttattcgcttcgaagattttattgtacagattagcgttaccgtagacctgtttggaaatggcactcagagtgtcgccagacttaacggtataaaactggctggcagtggctggtgtcgccgttttcacctgatcatcgacactggcaataccggaaatattccccaccgcaacaaggattttctccttcgcctcctgactcaggccgtcaccagtgaccgtcgctttgccgtcggcaatttgaatattcactttatcggcatccggtataccggttttgttcagatgctcctgcaccttcttcgcctgatcgtctttatcgtgctgacctgtaaccgcgtcccagagtttttctccggcatctttcacaaaattgaacagacccatagctacctcattcgttaacggaaacactcagaaagtgtagcagaggaacgcggcgcgttaacgccgcggggatgagcacaggtttaatcgcgggtttgcacccagaacgcgtgaatcaaaccggggatatacccaagcagtgtcaacagaatattaataatgaacgcccaaccgaaccctttaccgagcagcacgccgagcggcggcagaatgatggtgatgacgattctccagaaacccatatgtactccctataagaaaattactcattgtttaaaaagagattttatctcttaagcgtagtaattttagcggagcctgccagtttcagcttacgcttttactctcatttacgctgctgaggctggtatatgttgcatttttagtttagagtttacttaatttagaaaatacttaaataaatatgactgaactcgcgcaattacaggccagtgccgaacaggcagcggccttattgaaagcaatgagccaccctaaacgattgctgattctgtgcatgcttagcggttcccccggcaccagcgcgggagagctgacgcgcattaccggactgagtgcctctgcgacatcacagcatctcgctcgtatgcgggacgaagggcttatcgacagccaacgggatgcccaacgcattctatattccattaaaaatgaggcggtaaatgccattatcgccaccctgaaaaatgtctattgtccgtaaggagtcactatggctttgacaaccatttcgccgcatgatgcacaagaattaatcgcacgcggcgcaaagttaatcgatattcgtgatgctgatgaatatcttcgtgaacatattcctgaagcagatctggctccattatccgtgctggaacagtcaggtcttccggctaaattacgtcacgagcaaattatattccactgccaggcaggtaaacgcaccagtaataatgccgataaattagcagcgattgccgcccccgcagaaatctttttactcgaagatgggattgatggctggaaaaaagcaggattgccagtagcggtaaataaatctcaacccttgccgttaatgcgccaggtgcagatcgctgcgggtggtttaatattaatcggcgttgtactgggttataccgtaaatagcggtttcttcttattaagtggctttgttggtgccgggttactgtttgcaggaatcagcggtttttgtggaatggcaaggttgttagataagatgccgtggaaccaacgagcttgagaagcgacgccggacgcgccctagcagcgacatccggcctcagtaattagatcaggaaatcgtcgagagatttaccttctgccagcgcctgagcaattggcttcggtgtacggccctgaccggtccaggttttagtttcaccgttaacatcggtgaatttatatttcgccggacgcggctggcgttttttaccagcgcgtggtgcagcagcagagctattacccaataactcttccgggttaattccgtcagctttcatcagctccagccaggtgctaattttttcctggcgctctgccagttcacgctgctgctgttcttcttcttcacgtctttctttagtgacaaccctgaatttttcgagcatttcttcaagaacgtcaatggagaattcgcgagccatcgcacggagggtgcgaatgttatttaaactttgtaacattacggacataataaagaaaaccttttaacgccaaaacaaaaaaagtatttcgtcgcgtagtgtaagcgatcacttattatatttccacaaaatttaatctatttacagtcctgcgcgagattatttcagctgttattttctgaaactctcagaataatttcaagattatatattagccattttgatgagtaatttagattattggtgaacagagcggcgctctctgctcgctaattccgcaagcctgacaaaatcaaagtgaataaaaatgcaatataacagaataaaagaaaacatccatcactggtgctttctgctgttaatgtacattgtctggcataaaaaatgctgaaaatgacccagctactacatacaccgaattctctacgcttatagcgttacctcacccccaaactttcattagtgatattaaaggtaaggccatatctaattgatttaattaaaaataaatcatatcggcatgtaaaaatccacaatgtacaaaaaacgagccgttacggaatattttatctacaaaaactgactaaataaaaatttttcactaattgattagtcatagccagcgatatacgctatgcgaaaatgcagatggcaatgagatccactgctttcatctccattaacatcccattacgcttttattaaggagcattagcatgttctcaccgcagtcacgcttgcgtcatgcagttgcagatacgttcgcgatggttgtttactgttctgtcgtgaacatgtgtattgaagttttcctctccggaatgagcttcgaacagtctttttattccagattggtagcgattccggtgaacatcttaattgcatggccatacggtatgtaccgtgatctgtttatgcgcgcggcacgcaaagttagcccgtcgggctggataaaaaatctggcggatatcctggcttatgtgacgttccagtcaccggtgtatgtggcgatcttgttagtggtgggcgcagactggcatcagattatggcggcggtcagttcaaacatcgttgtttcgatgttgatgggggcggtttatggctacttcctcgattattgccgccgactgtttaaagtcagccgttaccagcaggtaaaagcctgactcttcttttcgcgactggcatcgccagtcgcgtctttaactggcttcgccaaataaaccattcaaataacgttcaagcgcaacacgcgaactaaagccatgcgggataccgtaatgctcgtgtcgctcgcctgctaaatagagcggaaattgctggtaatgatcgcaagttttaatatcggaagcgggttcagccagtgtcgaactgcgttcttttaatgttggatgaattaccagagcggtacgtcccattcgcgcttcgcgattaacatagacataattttccccacggcggtaaccatacgctttctgggttaccacatcgacagtaaaaccgactttttcaagtacgcgcgccacctcgtctggtcgtaaatacatatttgatcctcgttattatcaaccgcgggcctaccttacctgattgcgcattcacaacgctttcagaaaagtccataaagccgcgatgaacctcagttaagaaaattatggtctacactgaaaattacatcgaattctaatgggggatcatatgtttaaccgaccgaaccgcaacgacgttgatgatggcgtgcaggatatccagaatgatgtcaatcaattagctgacagcctcgaatctgtattgaagtcctggggcagcgacgccaaaggggaagctgaagccgcacgcagtaaagctcaggcattgctgaaagaaaccagggcgcgaatgcatggtcgtactcgcgtccagcaagccgcgcgcgatgccgttggctgcgcggattcttttgttcgtgaaagaccctggtgtagcgtgggtacagcagctgcggtaggtatttttatcggcgcactgttaagcatgcgcaaatcgtagtgcaaaaatgataataaatacgcgtctttgaccccgaagcctgtcttcggggtttctttttgcctggtgaatcacaaaaatccccctaccccgtcacgctcatatccagggtaatttcgaccactatttgctatatattgtgtggttgaatcttttttcaactacatctagtatctctgtatcaacagagagacaacccgacgcgtatcatcgcgccgtatcttcattttaaacggaaatacgaatcatgcgcattactatttacactcgtaacgattgcgttcagtgccacgccaccaaacgggcgatggaaaaccggggctttgattttgaaatgattaatgtcgatcgcgttcctgaagcggcagaagcgttgcgtgctcagggctttcgtcagttgccggtagtgattgctggcgatcttagctggtctggtttccgtccggacatgattaaccgtctgcatccagcgccacacgcggccagtgcatgagccagctcgtctacttctccagcagctccgaaaacacgcagcgttttatcgaacgtttaggtctgcccgcggtgcgcatcccgctcaatgagcgggaacggattcaggtagacgagccttacatcctgatcgtgccctcttacggcggcggcggtacggctggcgcggtgccacgacaggtaattcgctttttaaacgacgagcacaaccgggcgttgcttcgcggcgttattgcttctggtaatcgcaactttggtgaggcgtatggccgcgccggagatgtgattgcccggaaatgcggcgtgccgtggctgtaccgttttgaactcatgggtacgcaaagcgatatcgaaaacgttcgtaaaggagtaaccgaattttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccgctgtcgaacgatattcctgcctggcagacattaactgtcgtagaacaacaactgacgatgcgcgtttttactggcctgacgctgctcgacacgctgcaaaatgttatcggcgcgccttctctgatgcccgatgcactcacgcctcatgaagaagcggtattatcgaatatcagctttatggaagcggttcatgcccgctcttacagttcgattttctcgacgctatgccagaccaaagatgtcgatgccgcctacgcctggagtgaagaaaacgcaccgttgcagcgaaaagctcagattattcagcaacattatcgcggtgatgatccgctgaaaaagaaaatcgccagtgtgtttcttgaatcttttttgttctattccggtttctggctgccgatgtatttttccagccgcggaaagctgaccaataccgcggacctgatccgtctgattatccgcgatgaagcagtccacggttactacataggctataaatatcagaaaaacatggaaaagatatctctgggacaacgtgaagagttgaagagtttcgccttcgatttgttgctggaactctacgacaacgagttgcaatacaccgatgagctgtacgccgaaaccccgtgggctgacgatgtgaaagcgtttctctgttacaacgccaataaggctttgatgaatctgggctacgaaccgttatttcccgcagaaatggcggaagtgaatccggcaatcctcgccgcgctttcgccgaatgccgatgaaaatcacgatttcttttccggttcaggctcctcttatgtgatggggaaagcggttgaaacagaagatgaagactggaatttctgagggtgttattttcaaaaatatcactacccgcagcagggaaataattcccgccaaatagctttttatcacgcaaataatttgtggtgatctacactgatactctgttgcattattcgcctgaaaccacaatattcaggcgttttttcgctatctttgacaaaaaatatcaactttctcgatttgctctcagcccttatatcacgggaaattccggcgatttgctcgcatcaatattcatgccacatttgccatcaggggttgcctcagattctcagtatgttagggtagaaaaaagtgactatttccattgggtaatatatcgacatagacaaataaaggaatctttctattgcatggcaattaaattagaaattaaaaatctttataaaatatttggcgagcatccacagcgagcgttcaaatatatcgaacaaggactttcaaaagaacaaattctggaaaaaactgggctatcgcttggcgtaaaagacgccagtctggccattgaagaaggcgagatatttgtcatcatgggattatccggctcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaattggccggaattaatgccgaagaacgccgggaaaaagcccttgatgcactgcgtcaggtcgggctggaaaattatgcccacagctacccggatgaactctctggcgggatgcgtcaacgtgtgggattagcccgcgcgttagcgattaatccggatatattattaatggacgaagccttctcggcgctcgatccattaattcgcaccgagatgcaggatgagctggtaaaattacaggcgaaacatcagcgcaccattgtctttatttcccacgatcttgatgaagccatgcgtattggcgaccgaattgccattatgcaaaatggtgaagtggtacaggtcggcacaccggatgaaattctcaataatccggcgaatgattatgtccgtaccttcttccgtggcgttgatattagtcaggtattcagtgcgaaagatattgcccgccggacaccgaatggcttaattcgtaaaacccctggcttcggcccacgttcggcactgaaattattgcaggatgaagatcgcgaatatggctacgttatcgaacgcggtaataagtttgtcggcgcagtctccatcgattcgcttaaaaccgcgttaacgcagcagcaaggtcttgatgcggcgctgattgatgcgccgttagcagtcgatgcacaaacgcctcttagcgagttgctctctcatgtcggacaggcaccctgtgcggtgcccgtggtcgacgaggaccaacagtatgtcggcatcatttcgaaaggaatgctgctgcgcgctttagatcgtgagggggtaaataatggctgatcaaaataatccgtgggataccacgccagcggcggacagtgccgcgcaatccgcagacgcctggggtacaccgacgactgcaccgactgacggcggtggtgctgactggctgaccagtacgcctgcgccaaacgtcgagcattttaatattctcgatccgttccataaaacgctgatcccgctcgacagttgggtcactgaagggatcgactgggtcgttacccatttccgtcccgtcttccagggcgtgcgcgttccggttgattatatcctcaacggtttccagcaattgctgctgggtatgcccgcaccggtggcgattatcgttttcgctctcatcgcctggcagatttccggggtcggaatgggtgtggcgacgctggtttcgctgattgccatcggcgcaatcggtgcctggtcgcaggcaatggtgactctggcgctggtgttaaccgccctgctgttctgtatcgtcatcggtttgccgttggggatatggctggcgagaagtccgcgagcggcgaaaattattcgtccactgcttgatgccatgcagaccacgccagcgtttgtttatctggtgccaatcgtcatgctatttggtatcggtaacgtgccgggcgtggtggtgacgatcatctttgctctgccgccgattatccgtctgaccattctggggattaaccaggttccggcggatctgattgaagcctcgcgctcattcggtgccagcccgcgccagatgctgttcaaagttcagttaccgctggcgatgccgaccattatggcgggcgttaaccagacgctgatgctggccctttctatggtggtcatcgcctcgatgattgccgtcggcgggttgggtcagatggtacttcgcggtatcggtcgtctggatatggggcttgccaccgttggcggcgtcgggattgtgatcctcgccattatcctcgatcgtctgacgcaggccgttgggcgcgactcacgcagtcgcggcaaccgtcgctggtacaccactggccctgttggtctgctgacccgcccattcattaagtaactctgcacttgcccggtgacgccgggcattatcaccctgccaaaaaaaggaataacaatgcgacatagcgtactttttgcgacagcgtttgccacgcttatctctacacaaacttttgctgccgatctgccgggcaaaggcattactgttaatccagttcagagcaccatcactgaagaaaccttccagacgctgctggtcagtcgtgcgctggagaaattaggttataccgtcaacaaacccagcgaagtagattacaacgttggctacacctcgcttgcttccggcgatgcaaccttcaccgccgtgaactggacgccactgcatgacaacatgtacgaagctgccggtggcgataagaaattttatcgtgaaggggtatttgttaacggcgcggcacagggttacctgatcgataagaaaaccgccgaccagtacaaaatcaccaacatcgcacaactgaaagatccgaagatcgccaaactgttcgataccaacggcgacggaaaagcggatttaaccggttgtaaccctggctggggctgcgaaggtgcgatcaaccaccagcttgccgcgtatgaactgaccaacaccgtgacgcataatcaggggaactacgcagcgatgatggccgacaccatcagtcgctacaaagagggcaaaccggtgttttattacacctggacgccgtactgggtgagtaacgaactgaagccgggcaaagatgtcgtctggttgcaggtgccgttctccgcactgccgggcgataaaaacgccgataccaaactgccgaatggtgcgaattatggcttcccggtcagcaccatgcatatcgttgccaacaaagcctgggccgagaaaaacccggcagcagcgaaactgtttgccattatgcagttgccagtggcagatattaacgcccagaacgccattatgcatgacggcaaagcctcagaaggcgatattcagggacacgttgatggttggatcaaagcccaccagcagcagttcgatggctgggtgaatgaggcgctggcagcgcagaagtaatttttattcgggcggataaggcgtttttgccgcatccgccgttctgtgcacaatgcctgatgcgacgctggcgcgtcttatcatgcctacaaaccacatcgcacatttcaacaatctatctttcatcccatattcatcaacatccgctattattgatttccagcttaatcatcacctgatgaacaaaaataatgactaaacctaatcatgagcttagcccggcgctgatcgtgctgatgtctatcgccaccggtctggcggtagccagtaactattacgcccagccattgctcgacaccatcgcgcgtaacttttccctttccgccagttcggcaggctttattgttaccgccgcgcagttgggctatgccgcaggtctactgtttcttgttcccctcggtgatatgtttgaacgccgccgcctgattgtctcgatgaccttactggcggcatgttgattaccgccagcagtcagtcgctggcgatgatgatcctcggtacggcattaaccggtttattctcagtcgtggcacaaattctggttccgctggcagcgacgctggcttcaccggataaacgcggcaaagtggttggcactattatgagcggtctgctgttggggatcttgctggcacggacagttgccggattgctggcgaatctcggcggctggcgcaccgtcttttgggttgcttcggtgttaatggcactgatggcgctggcattatggcgtggtctgccacaaatgaaatcagaaacccacctcaactacccacagttgttgggttccgttttcagtatgtttatcagcgataaaattctgcgtacccgcgcgttgctgggctgcctgacctttgccaatttcagcattctctggacctcaatggcctttttgcttgccgctccaccttttaactacagcgatggtgtcattggtctgtttggacttgcgggagctgccggagcgttgggcgctcgtccggcgggcggttttgccgataagggcaaatcgcaccacaccacaactttcggtctgctgctgctattactttcatggctggcgatctggtttggtcacacttccgtactggcgttgattatcggaatcctggtgctggatctcaccgtgcagggcgtgcatatcactaaccagacggtaatttatcggatacatcctgatgcgcgcaatcgcctgaccgcaggttacatgactagctactttattggcggtgccgccggttcgctaatttcagcctcagcctggcaacatggcggttgggctggcgtttgtctggctggcgcgacgattgccctggttaacttactggtctggtggcgaggttttcatcgtcaggaagccgcaaattaagcaatcagcaaccgttttcgtggctttacacttataagggtgttaagaagcccatcagtctgataaggttaagatattcattcagtctatttataatattaacaatcgttaagcgtacactctatggaaagccctactccacagcctgctcctggttcggcgaccttcatggaaggatgcaaagacagtttaccgattgttattagttatattccggtggcctttgcgttcggtctgaatgcgacccgtctgggattctctcctctcgaaagcgtttttttctcctgcatcatttatgcaggcgcgagccagttcgtcattaccgcgatgctggcagccgggagtagtttgtggattgctgcactgaccgtcatggcaatggatgttcgccatgtgttgtatggcccgtcactgcgtagccgtattattcagcgtctgcaaaaatcgaaaaccgccctgtgggcgtttggcctgacggatgaggtttttgccgccgcaaccgcaaaactggtacgcaataatcgccgctggagcgagaactggatgatcggcattgccttcagttcatggtcatcgtgggtatttggtacggtaataggggcattctccggcagcggcttgctgcaaggttatcccgccgttgaagctgcattaggttttatgcttccggcactctttatgagtttcctgctcgcctctttccagcgcaaacaatctctttgcgttaccgcagcgttagttggtgcccttgcaggcgtaacgctattttctattcccgtcgccattctggcaggcattgtctgtggctgcctcactgcgttaatccaggcattctggcaaggagcgcccgatgagctatgaggttctgctgcttgggttactagttggcgtggcgaattattgcttccgctatttgccgctgcgcctgcgtgtgggtaatgcccgcccaaccaaacgtggcgcggtaggtattttgctcgacaccattggcatcgcctcgatatgcgctctgctggttgtctctaccgcaccagaagtgatgcacgatacacgccgtttcgtgcccacgctggtcggcttcgcggtactgggtgccagtttctataaaacacgcagcattatcatcccaacactgcttagtgcgctggcctatgggctcgcctggaaagtgatggcgattatataacccacaagaatcatttttctaaaacaatacatttactttatttgtcactgtcgttactatatcggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcaggggattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaacgcgtcatctcgctcaaaaatccagatttataaaagaaaaaatgactggccagcatcgcaacatgctggcctttttggcaagcaggtcggctcagccgatgagttaagaagatcgtggagaacaatatgagcgcaaatgcggagactcaaaccccgcagcaaccggtaaagaagagcggcaaacgtaagcgtctgctcctccttctcaccttgctctttataattattgccgtagcgatagggatttattggtttttggtactgcgtcacttcgaagaaaccgatgacgcatacgtggcagggaatcaaattcaaattatgtctcaggtgtctggcagcgtgacgaaagtctgggccgataacaccgattttgtaaaagaaggcgacgtgctggtcactctcgacccgacagatgctcgccaggcgtttgaaaaagccaaaactgcactggcttccagcgttcgccaaacccaccagctgatgattaacagcaagcagttgcaggcgaatattgaggtgcagaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgcgattcaacaatacaatgccaatcaggcgatgattctggggactaaactggaagatcagccagccgtgcaacaggctgccaccgaagtacgtaacgcctggctggcgctggagcgtactcgtattatcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcactatcaccacggatatttacggcgatgatgtgaaatacaccggtaaagtggttggtctggatatgggcacaggtagcgcgttctcactgcttccagcgcaaaatgcgaccggtaactggatcaaagtcgttcagcgtctgcctgtgcgtatcgaactggaccagaaacagctggagcaatatccgctgcgtatcggtttgtccacgctggtgagcgtcaataccactaaccgtgacggtcaggtactggcaaataaagtacgttccactccggtagcggtaagcaccgcgcgtgaaatcagcctggcacctgtcaataaactgatcgacgatatcgtaaaagctaacgctggctaatccagaggtgcgtgtgatgcaacagcaaaaaccgctggaaggcgcgcaactggtcattatgacgattgcgctgtcactggcgacattcatgcaggtgctggactccaccattgctaacgtggcgatccccactatcgccgggaatctgggctcatcgctcagccagggaacgtgggtaatcacttctttcggggtggcgaatgccatctcgatcccgcttaccggctggctggcaaagcgcgtcggggaagtgaaactgttcctttggtccaccatcgcctttgctattgcgtcgtgggcgtgtggtgtctccagcagcctgaatatgctgatcttcttccgcgtgattcaggggattgtcgccgggccgttgatcccgctttcgcaaagtctattgctgaataactacccgccagccaaacgctcgatcgcgctggcgttgtggtcgatgacggtgattgtcgcgccaatttgcggcccgatcctcggcggttatatcagcgataattaccactggggctggatattcttcatcaacgtgccgattggcgtggcggtggtgttgatgacactgcaaactctgcgcggacgtgaaacccgcaccgaacggcggcggattgatgccgtggggctggcactgctggttattggtatcggcagcctgcagattatgctcgaccgcggtaaagagctggactggttttcatcacaggaaattatcatccttaccgtggtggcggtggtggctatctgcttcctgattgtctgggagctgaccgacgataacccgatagtcgatctgtcgttgtttaagtcgcgcaacttcaccatcggctgcttgtgtatcagcctcgcgtatatgctctacttcggcgctattgttctgctgccgcagttgttgcaggaggtctacggttacacggcgacctgggcaggtttggcctctgcgccggtagggattattccggtgatcctgtcgccgattatcggccgcttcgcgcataaactggatatgcggcggctggtaaccttcagctttattatgtatgccgtctgcttctactggcgtgcctatacctttgaaccaggtatggattttggcgcgtcggcctggccgcagtttatccaggggtttgcggtggcctgcttctttatgccgctgaccaccattacgctgtctggtttgccaccggaacgactggcggcggcatcgagcctctctaactttacgcgaacgctggcggggtctatcggcacgtcgataaccacgaccatgtggaccaaccgcgagtcgatgcaccatgcgcagttgactgagtcggtaaacccgttcaacccgaatgcccaggcgatgtacagtcaactggaagggcttgggatgacgcaacagcaggcatcaggctggattgcccagcagatcaccaatcaggggctgattatttccgccaatgagatcttctggatgtcagccgggatattcctcgtcctgctggggctggtgtggtttgctaaaccgccatttggcgcaggtggcggcggaggcggtgcgcactaagtacaactaagccagttcatttgaactggcttttttcaattaattgtgaagatagtttactgactagatgtgcagttcctgcaacttctctttcggcagtgccagttcttcgttgctgttgatgcgtacgtcacgttccagaatgctacgcgcaatatcctgcgcttcctgcaacgagtgcatctggtaagtgccacactggtagacgttcagttccgggatctgattctgatcctgcactttcagcacgtcttccattgccgctttccaggcatcagcaacacgctgctcatctggcgtaccaatcagactcatataaaaaccggtgcggcagcccattggcgagatatcgataatctctacaccattaccgttaagatggttacgcataaaaccagcaaacaggtgctccagggtatggatccctctttctggcatcacttctttgttcggcacgcagaagcgcagatcgaacacggtgattgcgtcgccatgcggggtgttcattgttttcgccacccgaactgcaggcgcttccatccgggtatgatcgactgtgaagctatctaacaacggcatttagccacctccggtaatttttttaaaaattttctgaactctttcttcccaggcgagtctgagtatatgaaagacgcgcatttgttatcatcatccctgaattcagagatgaaattttggccactcacgagtggcctttttcttttctgtcaggcgtgtttttccagccacaccgcaaacggttcggtatcagcggcttccatttcctgctgacggcgttcagacgcctcgcgctcggctacaaaatcctcttcgcgcagaatttccagcggctcttcacgcagcagattacggtaggcttctgcaaatgctttgcctgttccgccaataccagtatcaatcatagaccttaagatacgggcagagaaagtcagatcgggattatcgaagcaggcaaccagttcatcacacactttctgatacgcttcgccgccgttaatactatccagcgtttgcgcgacgcgtttcagatcgcggaacagatctttacccacctgcggtaacgggaactgtgcggtttcgcagccgatacccagcgtcagacccggtttgcgaccttcgaggatcacccggttccagttaacgcgtgtacaggcaagttcgctactgctcatttccggtgcatcagccagcgcacaccagaccataaacaggtcgaggaatcgcacctgctgttcatctacaccaatcggcgagaacgggttgatgtccagcgaacgcacttcaatatattcaatgccgccacgtaacagcgcatcagaaggcgactcgccgctgcgggtaacgcgttttggacgaatcggcgcgtacagttcgttttcaatctgcaacacgttgctgttgatttgcagcctcttaccgtctttctcaataccaatcttcgcgtactcttccgatggcgttttgattgcctgtttaaggcccgctacgtactcgtaaagatcgttgaaggtaataccaagattgctttgcgatttattggtatagccgagatcgctcaaacgaagagaggtcgcatacggcaggtaatacataccgcactcggttttctcaaacggcagcgacgttggttttccttgcaggaaagaagaacaaatcgccggagatgcaccaaacagataaggaatgacccaaccgaaacgatagtaattgcggataacgcggaaatagcccgcagaaattttctctttggcatcagcgcccgagatatcaccgcacttcgcttgccagaatgccattggcaaagagaaattgtagtgcacgccggaaatggtttgcatcagcgcgccgtagcgatttttcagcccttcacgatacagcgttttaaagcgtccggtgttagaagtgccgtactgtgccagttcgatgtcctgaccttctgcgatgtagcatggcatacttaacggccacatccgctcatcgcccatattgcgcgccgtataacgatgcagatcgcgcataaaggtcagcatatgttcaatatcaccatccactggtgtaatgaattccagcaatgcttccgcaaaatcggtagtaatccatttgtgcgtcagtgcggaacctaatgcttcaggatgacctgttgttgccagtgtgccatcagcattaacacgcaaagtttcgcgctccagcccacgctgtatcccctttaacgcctgaggatgtttttccagccaggccagcgcctgtgatacgtccgggatcaaattgacctcccgcctgtcaaaatcgttttaattagcataactgtaatggtgaccatatgtgcaggcctacaattagtgccaccacatcatgccctgaacggtcgctgctgcaactgcaacatagcgtaacgctttaccaaggcacaaaaaaaagattaccggtccccacgagatgcgcatccatcccgctaacagacacagtaaatcgccaaccacgggcatccagcttaataatagcgtgactgcaccatagcgtttcagccagccggtagctttctcttgccagcgcgatgttttacgcaatggaaagaaacgcccaaggataacgttagttaaccctccaaggctattacccattgttgctgttaaaactaaaacccagggatgactgatcccggaaagcaacattgccaccagcacgacttcggagttgccgggtaatagtgtagcgctgagaaaactactggcaaacaacgagaaaagcgataacgcttcactcacagcaagcgaacatccacggcgtccatgcctgctgcacgggccgcctgaataccgaaatcggcatcttcaaagaccacacactgcgtcggttgcacgcccatacgctgcgcgcacaacaaaaatgtgtctggcgcgggtttatggtgtttgacgtgatcggcagcgacgacggcgtcaaaataatggcgtaatcccaggtgcgccagcaatgcctcagcgatggcgctttcactccccgttcctacagccattgggcgacgaccatgccaacttttcaccacatcaacaagaggaagcggttcgacgctatccagcagcatacttcttactgcttctgttttttcacgcgctaacgcatgcgggtcgagatcggcctgattcagctcaataattgcctgagcaatacgccaggtgggcgatccattaagcgcaatcatcgcctgaatatcgtactgaagaccgtagtgccctaatacttcgcgccacgctttacggtgcgtaggctccgtatccaggattgtgccatccatatcaaaaattaaacctgcataacgctcgtacatggtcttctcgcaagtcgaaaaatatgacgctactttagcgtaattgcttgattttgtcgctgatggcgaaggagaagaaaattcaggaaatggataaaggagttatttagaaatgagatatttttgaaggaaattttttggagaagatggtgcatccgggaggatgactcactgacgttcgcccttcgggccgttgctggcgcaacgttatccttcctggtgcctgcggttaataccgctatctcttcgataccttcattgctgaaggttacggagaatatggtgcatccgggaggattcgaacctccgaccgctcggttcgtagccgagtactctatccagctgagctacggatgcatcgggaaaacttattctactgctgatattgataccgctactaaagccatatcaattaagagatggtgcatccgggaggattactcgccttgcggctcgcccttcgggccgttgctaaagcaacgttatcatccctagtgcctgcggttaattccgctacctcttcgataccttcattgctgaagatttcggagaatatggtgcatccgggaggattcgaacctccgaccgctcggttcgtagccgagtactctatccagctgagctacggatgcatcgggaaatttattttactgctgatattgataccgctactaaagccatatcaagtaagagatggtgcatccgggaggattcgaacctccgaccgctcggttcgtagccgagtactctatccagctgagctacggatgcatcgggaaacttactttactgcagattttttgataccgctactaaagccgtatcaagtaagagatggtgcatccgggaggattactcgccttgcggctcgcccttcgggccgttgctaaagcaacgttatcctccctggtgcctgcggttattaccgccacctcttccataccttcatcgctgaaagtacgtagaatatggtgcatccgggaggattcgaacctccgaccgctcggttcgtagccgagtactctatccagctgagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgtttatcgctcatcgtcgctgcgtggcgcacatattactttctgagacttataagtcaaacaatttttcctacacttttatcgtttgcacacttcacgttcaattagtctgtaaaaacgtcaaaaagagtgttttatcaacagaagaatggaggtctgacagatagtagtaatgcaaaaaaatggagacttaagttgaatgaacgggagtaaagcgaaaagactatagagtgaaggagaaattttgagggtgcgtctcaccgataaagatgagacgcggaaagattagtaactggactgctgggatttttcagcctggatacgctggtagatctcttcacggtgaacagaaacttccttcggggcatttacgccaatacgtacctggttgccctttacccctaaaactgtcacggtgacctcatccccaatcatgagggtctcaccaactcgacgagtcagaatcagcattctttgctccttgaaagattaaaagagtcgggtctctctgtatcccggcattatccatcatataacgccaaaaagtaagcaatgacaaacacattacatctaagcagtcatggcattacattctgttaaacctaagtttagccgatatacacaacttcaacctgactttatcgttgtcgatagcgttaatgcgaatgccgtgaagcgagtccacggcattgcctgacgcttatattattgcaatttcgcgctgacccagcctttcacactggctaacgctgcaggtaaggccgcagcatccgtaccaccggcttgcgccatgtcaggacgtccaccacccttgccgcccacctgctgagcgaccataccaatcagttcccctgctttcacacgatctgtgacgtccttagatacgcctgcaatcagagaaaccttaccttcgactaccgttgccagcacgataattgtcgaccccagctgattttttaaatcgtcaaccatggtacgcaacattttcggctcaacaccgctaagctcgctaaccaacagcttaacaccattaacatcaattgccttactggaaagatttgcgctctcctgtgcggcagcttgttctttaagctgttgtaactctttttccagctgacgcgtacgttccagtactgagcgcactttatcagccagattattgctatcgcctttcagcagatgcgcgacttcgcttaagcgatcgctgtctgcatgaacggtggcgatagcaccttctccggttaccgcttcgatacgacgaacgcctgcagcagtacccgattcagagatgatgcggaacagaccaatatcaccagtgcggctggcgtgagtaccgccacacaactcggtagagaaatcgcccatgctcagcacgcgtacgcgctcatcatacttctcgccgaacagcgccatcgcacctttcgctttcgccgcttcgagatccatgatgttggtttcgatcggcaaattgcgacgaatctgtgtgttcaccaggtcttcgaccgcacgaatctcttctggtttcatcgcttcgttgtgtgagaagtcgaagcgcagcaccttgtcgttaaccagtgaacctttctgcgatacatgagtacccagaacctggcgcagcgcagcgtgcatcaggtgcgttgcggagtgattcagacgaatacgggcgcgacgagcctcatcaacatcagcctgcaccgcgtcgcccactttcagagaacccgcagcaagtttaccgatgtgaccaatcgcctggccgtatttctgcgtatcttccaccgcaaaggagaagttagcgcctttcagttcgcctttatcgccaacctgaccgccggattccgcatagaatggcgtttgatccagcacgaccacagcttcctggcctgcattgatggcatcaaccgctttaccatcaacaaacagcgcagtcactttgccgttcagttccagatggtcatagcctttaaattcagatgcactgtcaacacggatcattgcgttgtaatcggcaccaaagccgctggcttcgcgcgcgcgacgacgctgctcttccattgcagcttcaaaaccagcttcgtcaactttgatgttgcgctcacgacaaacatcagccgtcaggtcaaccgggaagccataggtgtcgtacagacggaaagcagtttcaccatccagcgtatcaccagaaagttttgccagctcttcatccagcaacgccagaccgcgctccagagtacgagcaaactgctcttcttcagtcttcagcacctgctcaacctgcgcctgctggcgtttcaggtcttcacccgcagagcccataacgtcgatcagcggaccaaccagtttgtagaagaaggtttctttcgcgccgagcatattaccgtgacgcactgcgcgacgaatgatacgacgcagtacataaccacggttttcattggacggcattacgccatccgcgatcaggaacgcacaagaacgaatgtggtcagcgattacgcgcagcgatttattgctcagatcggttgcgccagtgactttcgctaccgcctggatcagcgtgcggaacaggtcgatgtcatagttagagttaacgtgttgcagcaccgcagcaatacgctccagacccataccggtatctacagacggcttcggcagcggttccatcgtgccatcggcctggcggttgaactgcatgaagacgatgttccagatctcaatgtagcggtcgccgtcttcttccgggcttcccggagggcccccccaaatgtggtcgccgtgatcgtagaagatttcggtgcacgggccgcacggaccagtgtcacccatctgccagaagttgtcagatgcgtatggcgcacctttgttatcgccgatgcgaataatacgttcgcgcgggatccctacttctttttcccagatttcgtaggcttcgtcgtcgctttcatagacggtaacccacagacgctctttcggcagggcaaaccatttttcgctggtcagcagttcccatgcaaactgaatggcatcgtgtttgaaatagtcgccgaagctgaagttgcccagcatttcgaagaaggtatggtgacgcgcggtgtaaccgacgttttccaggtcgttgtgtttaccacccgcacgcacgcagcgttgggaagtggtagcgcgggaataattacgcttgtcgagcccaaggaacacatccttgaactggttcatcccggcgttggtaaacaacaaagttgggtcgttatggggtaccagggagctgctggcaactacctgatgtcccttactatggaaaaagtcgagaaacgcctgacggatctcagcggtgctcttgctcataattatcctgaaatcaagctaacgaaatatcgccaccagctccagcgtgtcttaaccgccgggctggtaactgaaaagtgggaataagataagttttcttgactgggaagtaaaataccgtatgcgttcagtcggcaaaatttcgccaaatctcctggatatcttccatcagatagccacgatagagcagaaaacgctggatcttaactttttctgaaaagacagttggcaaaggttcgccatattttcgcgtcgcctgatcgcgcgccagtgcgcaccagtcgatgtcacattcacgcatcgctttttctgtcgcttcgcgggaaatacctttctgattcagttcctggcgaatacgcgcaggtccataacctttgcggctacggctggcgataaagcgcgcaacaaatcggctgtcatcgagatagccatgttcatggcaccaggcaataacgcgctcgtaatcttctgccgtagcatcaatctcttctgggccatttttgcccataatcggtgccgcgagtttacgtcgcagttcttgctcactgtgatcgcgcaccgccagaatgcgtaccgcacgatccaacaggcgagcatatgccgggcgacgggatgttgattctgtcatggcatatccttacaacttaaaaaagcaaaagggccgcagatgcgacccttgtgtatcaaacaagacgattaaaaatcttcgttagtttctgctacgccttcgctatcatctacagagaaatccggcgttgagttcgggttgctcagcagcaactcacgtactttcttctcgatctctttcgcggtttccgggttatctttcagccaggcagtcgcattcgctttaccctgaccgatcttctcacctttgtagctgtaccacgcgcctgctttctcgatcagcttctcttttacgcccaggtcaaccagttcgccgtagaagttgataccttcgccgtagaggatctggaattcagcctgtttaaacggcgcagcgattttgttcttcaccactttcacgcgggtttcgctacccaccacgttttcgccctctttcaccgcgccgatacgacggatgtcgagacgaacagaggcgtagaatttcagcgcgttaccaccggtagtggtttccgggttaccgaacatcacaccaattttcatacggatctggttgatgaagatcagcagcgtgttggactgcttcaggttacccgccagcttacgcatcgcctggctcatcatacgtgccgcaaggcccatgtgagagtcgccgatttcgccttcgatttccgctttcggcgtcagtgccgccacggagtcaacgacgataacgtctactgcgccagaacgcgccagggcgtcacagatttccagtgcctgctcgccggtgtccggctgggagcacagcaggttgtcgatatcgacgcccagtttacgtgcgtagattgggtccagcgcgtgttcagcatcgataaacgcacaggttttaccttcacgctgcgctgcggcgatcacctgcagcgtcagcgtggttttaccggaagattccggtccgtagatttcgacgatacggcccatcggcagaccacctgccccaagcgcgatatccagtgaaagcgaaccggtagagatggtttccacatccatggaacggtcttcacccaggcgcatgatggagcctttaccaaattgtttctcaatctggcccagtgctgccgccaacgctttctgtttgttttcgtcgatagccatttttactcctgtcatgccgggtaataccggatagtcaatatgttctgttgaagcaattatactgtatgctcatacagtatcaagtgttttgtagaaattgttgccacaaggtctgcaatgcatacgcagtagcctgacgacgcaccgcatcacggtcgccgctgaagcattcccgccgggtaatgccttcaccgcgggcagtggcaaaagcaaaccagacggtgccgacaggcttctcttcactgccgccatccggcccggcgataccactaatagacacggcataatcagcacgagccgctttcagtgcgcctatcgccatttccaccacgacgggttcactcaccgcgccatgctgcgccagcgtctcttcgcgtacgccgatcatctgcgctttggcttcgttactgtaggtgacaaatccgcgttcaaaccaggcggagctaccggcaatatcggtaatcactttcgctacccaaccaccggtacaagactcggcagttgttacggttgcgccacgggctttcagcgcctgcccaacctgttcacttaactgcatcagttcactgtcagtcatcacaacctctgtcagtcaaaaatttatgccggacaagatagcactttcgtcaggaagatggtgttggcgttgcaattttacgaggaggattcagaaaaaagctgattagccagagggaagctcacgcccccctcttgtaaatagctactgtactcgcgccagcgccacggcttgtcctaactgccagaccgccattgcgtaatgggtgctgtggttgtaacgggtgatggtgtagaagttcggcagaccgtaccagtactggtagccggtgccaacatccagacgcagcaggctggcttgttgatggttgcccagcggctgctgtggcgttaaacctgcggcggcaagctgcgaaatgctgtacttagttttgaagccatttggcaagcctggagcctgaccgtttgccattaccgcgacctgatcgcctttcacccagccgtgcgctttgaaatagttcgccacgctaccgatcgcatcaaccggatcccacaggttgatatgcccgtcgccgctgaaatctaccgcatattgtttgtaagacgacggcataaactgtccgtagcccatcgccccggcaaaggaacctttcagattgagcggatcgtcctgctcgtcgcgcgccatcaacaggaaggtttccagctcgccagagaaatactccgcgcggcgtgggtagttaaatgacagcgttgccagcgcatcgaggatgcgagttttccccatcacgcgcccccagcgggtttcaacgccgataatcccgacgataatttccggcggtactccatacacctgccacgcgcgattcaacgcatcttcatactgattccagaaaaccacaccgttctgcacgttgtccggcgtaataaattttttgcgataacggagccatgcgccgttcggacctgatggcggtttcaccgatgtggttggtgcctggttatccatcagccgcagtaccgaatccagacgcttcgcctgggagagaatttcctgcaactgctgacgatcgaaaccgtgtttgttcaccattttgtcgatgaactgctgggcattcgggttattagcgaaatcgccgcccatctgcatcacattgtgctgcggctcaagcaggaagccgccagacggcgttccggtggtcgtatcagtctcagtaggttttggcttgctgctacaggcggcaagcaacacaaaaaggggaagcaatgttacataacgacgcttgaacatgaggggtccatttaacagattcaaccaggggcaagtatggtaaagcatcacgccccgcacaaggaagcggtagtcactgcccgatacggactttacataactcaactcattcccctcgctatccttttattcaaactttcaaattaaaatatttatctttcattttgcgatcaaaataacacttttaaatctttcaatctgattagattaggttgccgtttggtaataaaacaataaatcctgaaggagagaacaatgatagaaaccattactcatggtgcagagtggtttatcgggctgttccaaaagggcggagaggtgtttaccgggatggtgaccggcattcttccgctgttgattagcctgctggttatcatgaacgcactgattaattttatcggtcagcatcgtattgaacgttttgctcaacgttgcgccggtaaccctgtttcccgttacctactgttaccgtgcattggcacgtttgtcttttgcaatccgatgaccctaagcctgggtcgctttatgccggaaaagtacaaacccagctactacgcggcggcctcttatagctgccactcaatgaatggcctcttcccccatatcaaccctggcgaactgtttgtttatcttggcattgccagcggtctgacaacgctgaacctgccacttggcccactggcggtgagttatctgctggttggtctggtcaccaatttcttccgcggctgggtgaccgatctgaccaccgccatttttgagaaaaagatgggcattcaacttgaacaaaaagttcacctggcaggagcaacatcatgacgcatattcggatcgaaaaaggaacgggtggctggggcggcccgcttgagctgaaagccacgccgggaaaaaaaatcgtctatatcaccgccggtacccggcctgcgattgttgacaaactggcacagcttactggctggcaggctattgacggatttaaagaaggtgaacccgcggaggcggaaattggtgtcgcggtaatcgactgtggcggcacattacgctgcggcatctatccgaaacgacgtattcccaccattaatatccactcgacgggcaagtccggtccgctggcgcagtacattgtggaagatatttatgtctctggcgtaaaagaagaaaacatcactgtagtaggtgatgcgacaccacaaccctcttccgtgggccgtgactatgacaccagtaagaaaatcaccgaacaaagcgatggtttactggcgaaggtgggaatgggcatggggtccaccgttgcggtgctgtttcaatctggtcgtgacaccatcgacactgtattaaaaaccattctgccgtttatggcattcgtctcggcgctcattggcatcattatggcttctggccttggtgactggattgcccacggtcttgctccgctggcgagccatccactgggtctggtcatgctggcgctcatctgttccttcccactgctttcacctttcctcggcccaggcgcagttatcgcacaggttatcggcgtattgattggcgtgcagattggtctcggcaatattccgccgcatctggctttaccggcactgtttgccatcaacgcgcaggcggcctgcgacttcatcccggtcggtttgtcgctggcggaagcccgtcaggacacggttcgcgtcggtgtcccttctgtactggtgagccgctttttaaccggcgcgccgactgtactgatcgcctggtttgtctccggttttatctatcaatagaggctgaaacatgaccgttatttatcagaccaccatcacccgtatcggcgcgagtgccattgacgccctcagtgaccagatgctcatcacctttcgtgaaggcgcgcctgcggacctcgaagagtattgcttcattcattgccacggcgagttgaaaggtgcactccatcccggtttgcaattttcactcgggcagcatcgctatccggtgaccgctgttggcagcgtggcggaagacaaccttcgcgaactgggtcatgtcaccctgcgcttcgatggtttaaacgaagcggaatttccgggcactgtccatgtggcaggccctgtccccgacgatatcgcgccgggatcggttttgaagtttgaatctgttaaggagtaaaaaatgaatcaggttgccgttgtcatcggtggtgggcaaaccttaggcgcgttcctgtgccacggtctggctgccgaggggtatcgcgtcgcggttgtcgatattcagagcgacaaagccgcaaatgtggcacaagaaattaacgccgaatatggtgaaagtatggcgtacggttttggtgctgacgccactagcgagcaaagcgttctggcgctctctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcgcgtgaattttcgcgtttgatgatccgcgacgggattcaggggcgcattattcagatcaactcgaaatccggcaaagtgggcagcaaacacaactctggctacagcgcagcgaaatttggtggcgtcgggctgactcaatcactggcgctggatctggcggagtacggcattacggtgcattcactgatgctcggtaacctgctgaaatcgccgatgttccagtcactgttgccacaatacgcgaccaagctgggtatcaaaccggatcaagtcgagcagtattacatcgacaaagtaccgctcaaacgcggctgcgattatcaagatgtgctgaatatgctgctgttctacgccagtcctaaggcgtcgtactgcaccggacagtcgatcaatgtcaccggcggtcaggtgatgttctgatcaacagcggagatccattaaggatctccgtgagactatagaatgcctgatgcgctacgctcatcaggcatacaggacttccgccactacattaaggaaaagttatggtatccgcactcatcaccgtcgccgttatcgcctggtgtgcgcaactggccttaggcggctggcaaatttctcgttttaaccgtgccttcgacacactatgccagcaagggcgggttggcgtgggccgttccagcgggcgctttaaaccgcgggtcgtggtcgccatcgcgctggacgatcagcagcgcatcgtcgacaccttgtttatgaaaggactgaccgtcttcgcccgaccgcaaaaaattcccgcaattaccggtatgcatgcgggtgatttacagcccgatgtgatctttccccatgatccactatcacagaatgctctatcattggcgcttaaactgaaacgtggataatttcgttgtgaatgttacttgcttgcgaagttatcattttgaaacctaaatcaggtaatcacgcccatgaaacctcgtcagcgtcaggccgccattctggagtatctgcaaaagcagggtaaatgctcggttgaagaattggcgcaatactttgacaccacaggcacaaccattcgcaaagatctggtcattctggaacatgccggaaccgtcattcgtacttatggcggagtggtgttgaataaagaggaatccgatccgcctatcgatcataaaacactcatcaacacccacaagaaagagctgattgcagaagctgccgttagttttatccatgatggcgattcgatcattcttgatgctggcagtaccgttttgcagatggttcccctgctctcgcgctttaataacatcacggtgatgaccaacagcctgcatatcgtcaatgcgctatccgaactggataacgaacaaactatcctgatgccaggcggaacgtttcgcaaaaaatcggcctcatttcacgggcaactggcagagaatgccttcgagcatttcaccttcgataaattgtttatgggcaccgacggcatcgatctcaatgcgggcgtaaccacctttaacgaggtttataccgtcagtaaggcaatgtgcaatgccgcgcgcgaagtgattttgatggcggactcatcaaagtttggccgtaaaagccccaacgtagtttgcagtcttgaaagcgtcgataagctgattaccgacgcaggtatcgatccggcgtttcgtcaggcgctggaagagaaagggatcgatgtgatcataaccggagagagcaatgagtgaagcactactgaacgcgggacgtcagacgttaatgctggagttgcaggaagcaagccgtttaccggaacgtctgggcgatgattttgttcgcgccgccaatatcatcctgcactgtgaaggcaaagtggtggtttcgggaattggcaaatcgggccacattggtaagaaaatcgccgcaacgcttgccagtaccggcactccggctttttttgtccatccggcagaagcgctgcacggcgatctggggatgatcgaaagccgcgatgtgatgctgtttatctcttactccggtggcgcgaaggaactggatctgattattccgcgtctggaagataaatctatcgcgctgctggcgatgaccggcaaaccgacgtcaccgctgggcctggcggcaaaagcggtgctggatatctccgtagaacgcgaagcctgcccgatgcaccttgcgccgacctccagcaccgtcaataccctgatgatgggtgacgcgctggcgatggcggtcatgcaggcgcgcggatttaatgaagaagattttgcccgctcccacccagccggggcactgggcgctcgcttgctgaataaagtgcatcatctgatgcgccgtgacgatgccatcccacaggtggcgttaaccgccagcgtgatggatgcgatgctggaactcagccgcaccggtctggggctggtggcggtatgtgacgctcaacaacaggtacaaggcgtctttaccgacggcgatttacgtcgctggctggttggcggcggcgcactcaccacgccagtcaatgaagcgatgacggtcggcggcaccacgttgcaatcgcaaagtcgcgccatcgacgccaaagagatcctgatgaagcgcaaaatcactgccgcaccggtggtggatgaaaacggcaaactcaccggcgcaataaacctgcaggatttctatcaggccgggattatttaatccttcaatcccagacgtttcgccagccgatgcaggttggcgacgtcggtttccagcatccgcgcgcaggcagcccagttgtgatgattttgtgccagtgcctgacgaatagtttcacgctggaacgcttctgtcgcttcacgcaggttttgcttaacaacgggcaccgccgccacttctggcgtcggcaacgtcacctcaggaaaagcaaaatgttgcgcctcaagaatcacttcatcgccgctgcgggtggctctcgccagaactaccgcccgatgaatagcatgttccagttcgcgcacgtttcccggaaaactgtagtgttgcagtaaatttcgcgctccggcacttaataccacgcgggagagcccctgccgcaaacgacactgctcgcagaaataccccgccagcagaatgacatcatcgccccgctcacgcagcggcggcaccgaaagtggaaacacgctcaggcgatgaaacaaatcggcgcggaatcgccctgccagcacctcttcgcgtaaatcgcggttagtcgccgccagcacgcgcacatcgacccgcaaacaacggtcatcgccaacgcgctgaatatcgccatactgcaacaccctcagcagcttggcctgcaatgccaacgacaactcgccgatctcatccagaaacagcgtgccgttatccgccatttcaaacttcccgctgcgattactgatagcgccagtaaacgctcctttcacatgcccgaacaactcactttccgccacactttccggcagtgcagcacagttgagatagaccagcggattcaccgcccgtggcgaggcttcatgaatcgctttcgccaccagctccttaccggttccagtctcaccgctgatcaggacgttgagatcggacgccgccacaatctcaatctcttttttcagttgcgtcatgccaggggacaagccaatcatctgcgtctgtttcaccgcttcaaacggcgtggcatcgcctggcagcatattctggctttccagttgttcaatcagcaacgcattgcttaacgctcccgccgccagcgcagcaatcagccgtagctcttcgtcgctgaaaacatcgaactgatcgggctgcatcccgtcgagcgtcagtgcgccgatcaggttttgcccggcaaacaatggcagaccaacgcaggcgtgaaccttcagactctcctgcccaggaatcaaaccgtcatagggatcgggcaattcgctgtctgcgggaaagcgcaccacatccccggcgcgggcaatcgcttccagccgtggatgcccttccagcgcaaagcgtctaccgagtacatcctttgccagaccgtcgatggcaagcggaataaactgccgcgaatcgtaacgtagcaacgcagacgcatcgcactccagcacctgacgtagcgtggtgatcaggcgctgaaaacgatcctggtgaccaatcccacgctgcaattcgatggcgatattcgccagcacatcaacggaaaaactcatctttgcctcactgtcaatttgactatagatattgtcatatcgaccatttgattgatagtcattttgactactcattaatgggcataattttatttatagagtaaaaacaatcagataaaaaactggcacgcaatctgcaattagcaagacatctttttagaacacgctgaataaattgaggttgctatgtctattgtggtgaaaaataacattcattgggttggtcaacgtgactgggaagtgcgtgattttcacggcacggaatataaaacgctgcgcggcagcagctacaatagctacctcatccgcgaagaaaaaaacgtgctgatcgacaccgtcgaccataaattcagccgcgaatttgtgcagaacctgcgtaatgaaatcgatctggcggatatcgattacatcgtgattaaccatgcagaagaggaccacgctggggcgctgaccgaactgatggcacaaattcccgatacgccgatctactgtacagccaacgctatcgactcgataaatggtcatcaccatcatccggagtggaattttaatgtggtgaaaactggcgacacgctggatatcggcaacggcaaacagctcatttttgtcgaaacaccaatgctgcactggccggacagcatgatgacttacctgacaggcgacgcggtgctgttcagtaacgatgctttcggtcaacactactgcgacgagcatctgttcaacgatgaagtggatcagacggagcttttcgagcagtgccagcgttactacgccaatatcctgacgccgttcagccgcctggtaacaccgaaaattaccgagatcctgggctttaacttaccagtcgatatgatagccacttcccacggcgtggtatggcgcgataacccgacgcaaattgtcgagctgtacctgaaatgggcggctgattatcaggaagacagaatcaccattttctacgacaccatgtcgaataacacccgcatgatggctgacgctatcgcccaggggattgcggaaaccgacccacgcgtggcggtgaaaattttcaacgtcgcccgaagcgataaaaacgaaatcctgactaatgtcttccgctcaaaaggcgtgctggtcggcacttcgacgatgaataacgtgatgatgccgaaaatcgccgggctggtggaggagatgactggtttacgcttccgtaacaaacgcgccagtgctttcggctctcacggctggagcggcggtgcggtggatcgtctttccacgcgcctgcaggatgcgggtttcgaaatgtcgcttagcctgaaagcgaaatggcgaccagaccaggacgctctgaagttatgccgtgaacacggtcgcgaaatcgcccgtcagtgggcgctcgcgccgctgccgcagagcacggtgaatacggtagttaaagaagaaacctctgccaccacgacggctgacctcggcccacggatgcagtgcagcgtctgccagtggatttacgatccggcaaaaggcgagccaatgcaggacgttgcgccaggaacgccgtggagtgaagtcccggataacttcctctgcccggaatgctccctcggcaaagacgtctttgaagaactggcatcggaggcaaaatgagtaacggcattgtgatcatcggttcgggcttcgccgcccgccaactggtgaaaaatattcgcaaacaggacgccactattccattaaccctgattgccgccgacagcatggatgagtacaacaaacctgacctcagccatgttatcagtcaggggcaacgtgccgatgaccttacccgccagacggcgggtgaatttgccgagcagtttaatctgcacctgtttccacaaacctgggtgacggatatcgatgccgaagcccgtgtggtgaaaagccagaataatcagtggcaatacgacaagctagtactggcaaccggtgccagtgcctttgtcccgcctgtgcctgggcgtgagttaatgctgacgttaaatagtcagcaagagtatcgcgcctgtgaaacgcaactgcgggatgcccgacgcgtgttgattgttggcggtggtttgattggtagcgaactggcgatggatttttgtcgtgcaggcaaagcggtcacgctaatcgacaacgctgccagtattctggcgtcgttaatgccaccggaagtaagcagccgcttgcagcatcggttgacggagatgggcgttcatctgctgttgaaatctcagttacaggggctggaaaaaacggattctggcattcaggcaacgctggaccgccagcgcaatatcgaagtggatgcggtaattgccgccaccggactgcgcccggaaaccgccctggcacgacgcgccgggctgacgattaatcgcggcgtttgcgtcgatagttatctgcaaaccagtaataccgatatttacgcgctgggcgattgcgcggaaattaacggtcaggtattgccgttcctccagccgattcaacttagcgcgatggtgctggcaaaaaatcttctcggcaataacacgccgctgaaactcccggcgatgctggtgaaaatcaaaacgccggaattaccgctgcatctggcaggcgaaacccagcgtcaggatttacgctggcaaattaataccgaacgccagggaatggtggcgcgcggcgttgacgatgctgaccagcttcgcgcctttgtggtcagtgaggatcggatgaaagaggcatttggattgttgaaaacattgccgatgtaggtgggctactgtgcctaaaatgtcggatgcgacgctggcgcgtcttatccgacctacggggacgcatgtgtaggccggataaggcgtttacgccgcatccggcaatggtgtccaaatgcaacacgttttatccgttctggacttcacccgctaaccaacgcgccgcagcaataaccccctgccccagagacaaaccgccatcacccgccggtaaactctgtggaaagagcaatgtgaaatcagcgagataatgcgccagacgtgcacgcagcaaacggttatgaataaccccgccgctaaataccagcgtagtgataccacgcatcgtggcctgctcacgcatcaacgcggcaaaaccctgcgccagcgcatcatgaaacgcccacgcgcgttgattaaccggtgcctgccagttcagccactgctgccagaaagtggcgagatccagttgattgtccacccgcggcattgtcaccggatgcgtcactccgtggcatgaggctgcgagcgcctccagagcacaagccgcttcaccttcataacttaacgtggctggcgcacagcccagtgccgccgccactgcatcgaaaaaacgcccacacgatgacgccagcggcgcgttaattccacgctcaatggcccgcgccagcacgctccagttttgctgttgcacacttgctgtttcagagtaattctgccactccggcacaaagcgcaggcactgcgccagcaggtttcgccacggctgcttcgctgccaaatcgccacccggaagcgccactgcaggcaagccgcccaggtgctcacattcgcgatagttcacccgcaggcactcgccgccccacaaagcgccgttctcccccataccgataccgtcgagcgtcaaagcaatgacatcaccgccatccagcggccactgatgctctgccagacacgccgctgcatgggcatgatgatgcagtaccgtttgcgtcggcagattcatttcacgcgcccactggctggagacatagcccggatgcgcgtcatgcacaacgtattgcggggtaaaatcgtagatgttttgcatcaggcgtaacgcttcgcgccactgcatctggatgccatcgtcacttaaatcgcccagatgctgactcaacaccgcttgttcaccgcgcaccaggcagaaggtatttttcagatccgcgccgagacacagcacaggcggaacatttttaaagcccggaggcaaagccagcgcatccggcacatacccccgcgaacggcgcagcatttcgccgctttcgcgcaccaccgaatcatccatccgctgcacgatgtcgcggttatgtatcaagaatccgtcggcaatgccctgcaaatccgccagcgcctgttcgttgctgatagctggtggtttaccgctcaggttgccggaggtcatcaccagcgggcattgcagttcctgtaacagcaaatgctggagcgggttcgcaggcaacattaccccgacttcgttaaggtcaggggcgatatcatcacaaagctcaggaacgtattttttatccaccagcacaatcggcgcggcgggcgtggtaagcaactggcgcgcagcgtctggtaaaccgtcagccactggcaacatgaccgccagcggtttcgccgggcgatgtttgcgcgcccgaagtgtcgccaccgcgttactgttacgtgcatcgcaggcaagatgaaatccgccaatccctttgatggcgacaattttgcccatttttaactgtgcgatagctgcctgtaatgccgcctcttgttccgcatgttcaccatgacttacccattcaagatgcgggccacactccgggcaggccaccggctgggcgtggaagcgacgatcgagcgggtcacggtactctttgtcacaggccggacatagcggaaacgccgccatcacggtaaacgggcggtcgtaaggcatggcgcgaataatggtgaaacgcgggccgcagtgggtacagttgataaacggataacgataacgccgttcgcctggggtattcatttcggcaaggcaagcagggcaagtagcggcatcgggaacaatttgcgtattcatggtgccgcctgtgctctggcgtatagtgaactcggtgggcagttgtgaccagataaacggctcacgctcgacgctatcaatacgcgccagcggcgggcagtgctgatacaattgaacaagaaacgtttccgggtcttcccgcagccggacttctacgccatcgccgtcattacagacatcgccgtgaagatttaattgctgtgccagctgccagacaaacggacgaaaaccgacgccctgcactttgccacgaatacgcagttggacaccgcaagatgtgttttttgccattgagttattcccgccatcatgaattgcgtaacccgccctgccggacacgacagcgtcgcatccggcagtcacaggtcggcgataccgcccgctccgtattctacgaatatttccgggaattcctttgatgccagaacagttctgtaagatttttagaacatcagcgccgtacggcggcgtttttctgcgctcagttgttcaagtttattacgatcgacacaaatcagcgcatgagtcgggcaagccgccatacacgccgggccgtcttcacgatggttgcacaggtcgcatttattggcttcggctttgtcagcccgtacattcagacccgcgccgctgttgcggatcaccggacgtaccaccacttccatcgcaccatacgggcaagccacaacgcaggttttgcaaccaatgcaacgttcctgcatcacatgaacaaaccctttatcacggctgatagcaccattcgggcagacgttagcgcacggtgcatcttcacactgacggcaaactgtcgccgtggaaatgttcacacctttaatgacatggatacgcggtaaaaaagtttccggggtcagcgatgcacagtcctgattttcctgatgagaaaccacgcacgctacttcacaggtacggcaaccaatacatttactcgcgtcagcaatgatgaaacggttcatcaaattctccagcaatgacagttaatgcgccgatacattcacaaatcatgccagtttttaatttactgttatttaaggaaattaatttctgtaatgcaggaaaaacgatgtcatcgacactagtgacgatgacatgtgatgacaatgtttatcgcgaaggagcaatgagtgagtcgcggcggatcagttttccgctgaaggttttcggcggtgagaaatccccgccatcgagcataaaaatcagccgtccaataatttcctgaatcatctcagtcaccggaatttttacgctggagagcgccggaacggtgtagggggcaatagcgatatcatcgaatccgataactgacacctgctctggcaccgctacgccgcgctcgtgtaacgctttcatcgcacctatcgccatatcgtcgttactggcaactaacgcgctaaatttagccccacgttcgagcaacatttctaccccttcggccccgctggcaggcgtccatttaccgttagcgataagtttttcattgagcgcaataccatgctgcgccagcgcgtctttatacccggcaagacgttcaatgctggtgggggaatccatcgagccggtaaggaaagcaatctcctgatgcccggcgtttatcaactctgccacggcgttaaaactggtctgtttatgatcgcaccagacgctatggctgctgtttttgcgcaggcggcgattaagcaccattatcggctgactgtgcgcgtcaatgatgtcatcgatctcatccacgcttaaaaaacgcgggtaaatcatgatcgcgtcgcagcgcagatccagcagatactgaatcgcctggcgctcttcttctgcgctgtgtttaccatctgccaatagcaactgccgccctttctcttccgccattcgcgcggcatgaaagagtaattcactaaaataaatgccgtggtaaagcgtgttggtcactaccagccccagcgtctgagtactcttcgccgacagattgcgcgccagcaagtttggacggtaaccgctctcttctaccgcctgaaacacgcgatctttagtctcctggctgacgtagccattacctgaaagcacgcgggaaacggtcgcttttgaaaccccggcgcgcttcgccacttccagcatcgtcgtcatcattttcatccctttacacgcaatcaacgcagtgtactgcaccgtttgccgattgtccttgcacaatcggcgggaaaaatattcaggtgaccggtttcacaaatataaaaaatgaacaattcactctcttgcttatttagtgacaactattcatgattttgtgaaaccggtttcttaattccgtttcagcatcggcatttttccgtcacgtcgactgataacaactacatctaccctactgataacaggataaaatccgatggccaaaaattatgcggcgctggcacgctcggtgatagcggcactgggcggcgttgataacatctcggcggtcacgcactgtatgacgcggttgcgctttgttatcaaagatgatgcacttatcgacagcccgacgttaaaaaccatccccggcgtgctcggcgtggtacgtagtgacaaccagtgtcaggtgattatcggcaataccgtttcacaagcctttcaggaagtcgtcagcctgctgccgggagatatgcagcccgcacagcccgtgggtaaacccaaactcacgctacgtcgcattggtgcggggatcctcgatgcgctgatcggcaccatgtcaccgctgatcccggcgattatcggcggatcgatggtcaaactgctggcaatgatcctcgagatgagcggcgtgctgacaaaaggatcgccgaccttaaccattctgaatgtgattggtgacggtgctttcttcttcctgccgctgatggtcgcggcatctgccgccatcaaatttaaaaccaatatgtcgctggcgattgccatcgcgggtgtgctggtacatccgagttttattgaactgatggcgaaagcggcccagggtgaacatgtcgaatttgccctgattccggtcaccgcggtgaaatacacctacacggtgatcccggcgctggtgatgacctggtgcctgtcatatatcgaacgctgggtggacagcattacaccggcggtgaccaaaaacttcctcaaaccaatgctgattgtgttgattgccgcaccgctggcaatcctgctgattggcccgattggtatctggatcggtagcgccatttcggcgctggtttacaccattcatggttatctgggctggctttcagtcgccattatgggcgcgctgtggcctctgctggtaatgaccgggatgcaccgcgtctttacgccaaccatcattcagaccattgccgaaaccggcaaagaagggatggtcatgccgtcagagatcggcgctaacctgtcgctgggcggttcatcactggcagtggcgtggaaaacgaaaaacccggaactgcgtcagacggcgctggctgcggcggcatcagccattatggcggggatttccgaaccggcgttatatggcgtggcgatccgcctgaaacgtccgcttatcgccagtcttatcagcggttttatttgcggcgcggttgccggtatggcggggcttgccagccactcaatggcagcgccggggctatttaccagcgtgcagttcttcgatccggcgaatccaatgagcatcgtctgggtgttcgcggtcatggcgctggcggtggtgctgtcgtttatcctcacactgttgctcggctttgaggatattcctgttgaggaagcggctgcccaggcgcgaaagtatcagagcgtacaaccgaccgtcgccaaagaagtaagtcttaattgaggatgaaaatgtcagtatttccagaaagttttttatggggcggcgcgcttgccgccaaccagtctgaaggtgcgttccgtgaaggtgacaaaggtctgaccactgtcgatatgatcccacacggcgagcatcgaatggcggtgaaactggggctggaaaaacgttttcagttgcgagatgacgagttttatcccagccatgaggcgacggatttttatcatcgttataaagaagatatcgccctgatggcagagatgggattcaaggttttccgtacctcaattgcctggagccgtctctttccgcagggcgatgaaatcacgcccaatcagcagggcattgctttttatcgttctgtctttgaagagtgtaaaaagtacggtatcgaaccgctggtcacgttgtgccacttcgatgtgccgatgcatctggtcaccgaatatggctcctggcgtaaccgcaagctggtggagtttttcagccgctacgccagaacctgctttgaagcatttgatggtctggtgaaatactggctaaccttcaatgaaatcaacattatgttgcatagcccgttctccggcgcgggtctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagaccgggaaaacctgttttttatcgatgtgcaggcgcggggcacgtatccggcttactctgcccgcgtattccgcgaaaaaggggtaaccatcaacaaagcaccgggcgatgatgaaatcctgaaaaacaccgtcgattttgtctctttcagctattacgcctcgcgctgcgcctcggcggagatgaacgccaacaacagcagtgcggcgaacgtggtgaaatcgctgcgtaatccgtatctacaggtgagcgactggggctggggaattgatccactcggtctgcgtatcaccatgaatatgatgtacgatcgttatcagaagccgctgtttctggtggaaaacggcctgggcgcaaaagatgaatttgctgccaatggcgagattaacgacgactatcgcatcagctacttacgcgaacatatccgcgcaatgggcgaagcgattgcagacggcattccgctgatgggctacaccacatggggctgtattgatttagtttccgcctctacgggtgaaatgagcaaacgctacggctttgtctttgttgaccgtgacgacgcaggcaacggtacgctgacgcgcacgcgtaagaaatcattctggtggtataaaaaagtgattgccagtaatggggaagatttagagtaggtaacagtgccggatgcggcgtgaacgccttatccggcctacatgtcgcacgaaccatgaaggcccgataagcgcagcgcatcgggcaatttagcatttggcatcagagctggttcaccccatcaagaacatccctgtcctgattccttaatgaaaaactactcttcttccaccgctaactgcgcgaagccgccatttccttcccagccttccagtcgttgataaacggtttctaccgcatctttaatcggctgggtcatcgggtagtaaaagccgacgatatccggctgaatgccgaggaaaatcacttcgccaatatcttctttcaactggtcgataaggtaattcaacggcatgttatgggtagtcatcataaacatctcggcgatatcatccgggtcgatgatgcggatctcgccggggtttagccccatatccgtggcgtcgacaatcagcagtcgtgtcgggcgcagttcacggatagcgacgatgtcgttttccggtgcgctaccgccgtcaatcaccacccagttacctttcggcgcggcggcgcacttttccgccagcagcggacctgcgccatcatcgcccatcatgctattgccaacacagagtaaaacgtcagtcacgcagtctcctcaccatcaaatagatggcgttttcctgatgaatatcatgcagcatacttaacagcattgtactccattcctgctgctgcgaagtttgcgctgcccgggctttatcgaatgcgttggccagcatcggcacatggttaatgtcgatgacgatctcaccatatttcggcacgccttccattttgcggcgggcttcactgcctgcctccagagtggcaatccatgccagatattcatcccacgggcaggtgagcgccgcttccaggcaatcgataaccccaaggtggtgaccaatcgccaggctgtaatagaccacctgctgcgcctcggcgggcgtggcatcgttctcatcaataaatttacggctcagttgactgaacaccaccttttcactcatcggatacgcgcctcttcaacaacatgattcagatggctgacaatctcgttcagacgcggatcgttttccgcttccagccagcgtgcaacctgttcttcgccctgccctaactgtgtaaggtaatcatcggcaatctgacgaccgtaacgataacccgccaggcgacgtgcttcgcgatccactttcacgcgcagcggctgcaccatatcaccatgcaggatctccgccggttgttcatccagttcacccggcccacgggcgtgaattttctgctccagcaggccgagcgccattgcaaagccgtacagcgtggcggcaggcgttggcgggcagccagggatataaacatccacagggacaattttatccgtaccgccccacacgcagtagagatcgtggaagatcccgccactgttaccgcaggcaccgtaggagatacaaattttcgggtccggcgcggactgccacgcacgcagcgcaggggatcgcattgcacgggtgaccgcgccggtaaacagtaaaatatccgcatgacgcggtgaaggaacgactttaatgccgaagcgttctgcatcaaacagcggcgaaagcgtggcgaaaatttcgatttcgcaaccgttgcagccgccgcagtccacgcggtaaacataggcagaacgtttgatttttttcagtaacgacgccttcatgctggcgatggattcatccaccgtcatggggaccggaatgccgttggcgtcacgggggcctaataaattgctcatcagatggcctctttcatatggcgagtcagttcaatacggtcggacggcaccaggcatttctggcgcttacattccgggcaagtctcaaagctttcgcggtggttttccgcgcggctgtcgccgttgtgcttaagcagcgcaatggcgtagtcgatctctttctggacggcgaaaggacgattgcagacgcggcagttgcacagcgcgaagcgggactgttgcaggaagtcttctttcttccacaccgccagttcgtactcttgcgacagtttgatcgccgccgtcgggcagacttcttcgcagcgtccacagaagatgcagtgcccaagattaaactcccaggcaagctctcctgtggcgaggtcagtttcaaccgttaaggcgtttgacgggcaggcattgacgcaggccgcgcagccgatgcactgctgcgggttctgctctggcttaccacggaagtttttatcaaccgcaatcggctccagcggataagacgaggtcgccgtgccggttttgatgacttttttgataaaggtaaacatggcgattccttatttcagcggcgagtttttacgctcaatgctgtaacgctcgagttctttgtacggcaccactttgctcttcttcttacgcacatcgaccacggtcatgcggtcggtacaggagtagcaagggtcgaggctaccgataatcagcggcgcatcggaaacggtgttgccgcgcagcatgtagcgcagggtcggccagttcgcgtaggtcgcggcacggcagcgccagcggtacagcttctggttgtcgccggtcatgctccagtggatatcatcgccgcgcggcgcttcggcaaagcccagcgcaaagcggtgcggaatgtaggtaaagccttccaccatcagtgggccacccggcaggttatccagaccgtagtcgatcatgttcagcgcggtatagacttcgttgatacgcactttcagacgggaaataacgtcgcagccctgctcgctgtggacttccattggcagcaggccatagccgacaaacgggtgatcggcgcgggtatcacgggcgtgaccgctggcacggaccatcgggccgacgttactgaagtcgcgagcgatttccgggtccagacgaccaatgccgacagtgcgctgttccatgttcggagtgctcagcagcacatccaccagctcctgcacttcacgacgcatctgttgtgccagctggcgggtctggatcatgtcgtctttcagcagatcgcgacgaatcccgccgatcaagttcaggccgtaggttttacgcgcaccggtaaggatctctgccattttcatggaggtttcacgcacgcggaagaactgcataaagccggagtcgaagccggtaaagtgacaggccaggccaaggttgagcagatgcgagtgcaagcgttctacctccagcagaatggcgcggatcatctgcgcacgttctggcacctgaatacccatcgcgttttccaccgacgtggtgtaggcggtgctgtgggcaaagccgcagatcccgcacacacggtcagagaggaaggtcacttcgttataacccatacgggtttccgccagtttttccatgccgcgatggacgtagaacagacggtagtcggcgtcgataatgttttcgccatcgacgaacagacggaagtggcccggttcatcagaagtgacgtgcagcggaccaatcggcacgacgttgtttttcttgtcgcccagttcgttgatgaactcgtaggtttcagcatcggtggtcggtgccggacgctgacgataatccatgctgtctttacgcagcggataaagttcatccggccagtcatccggcagcaccagacgacgttcatccggcagaccaaccggaatcaaaccgtacatatcgcgcacttcacgctcgccccacaccgccgccggaacgcgcggcgtcacggacggatattccggtttgttggcgtcaacttcgacgcgaaccgtaatccaacacttagtgcccttctccatcgacagcacgtagtaaacggcgtaatgaccattcagtttgcgttcgtcgttaccaaacagcaccgacagccagccaccctgtttgtagtaaagaaactccaccacttccggcaggtagttcacctttacggtgacagtcagctgatctttggtctgccaggcgtggtccagcacgacgcccggaaatgcctcattcagcgcggcgagataatgttgacctaatttttcttcagacatgctcaaactctctttaatcacgccgccagcaaggagacgaacgctaaaaatgcaaagccaaacccagcccaggtaatgcgcggagtaatatcaagacgcagacgggccatgctgttttcgaacagcgcgataaccaggacgccgaccaccagttttacgatggcaatcaccagcgccagcagcagtccaccggcggtgaaggtttccatttgtccccacggaataaacaccccgacgaacatctgcaacaccaccagctgtttcaggctgataccccatttcatgacgccaaagccgctgccgctgtattcagagagcgggccttcctgcagctcctgctcggcttccgccaggtcgaacggcagtttgcccatttcgataaaggtggcgaacgcacaggcacaaagcgccagtaccagcgggatgctctggctcagcggccagtgataaacggtgtcggtgatgttgctgatgttggtggaaccggcaacctgtgcggcaacccacagaccaagcagcagcatcggttcgaccagcacgccaagcatcgcttcacggctcgcgccgatagcggtaaacgggctaccggtatccagaccagaaatggcaaagaagaaacgcgcgatggcaaagagatacagtaaggtgatcaaatcacccagttgcggcagcggagaaccgacggtcaccaccggcagcgcagtagcgatagtcagcatgacgcccaccatcacatacggcgtcaggcggaacacccagccggaggcatccgggccgacgctctgacgccccagcagtttgataatgtcgcgatactcctgcaacacgcccggcccgcgacggttatgcaagcgggcgcgcgccacgcgggttataccggagagcagcggcgcaacggcaaataacaccagcgcctgaattaacggatataaaacactcattctcaggctcctcgtgaaacaataatcaccaccagtaccgccagttcaaccagcgccatccggcggaacagcaacgcactcccctcgcactgccagcccggcaccagagacaccggattcagccatttgcgtagtttcagcaccggcgcaaacgcctgtttcaccggcatggcaaaaccgtgagcggtaatcaccattgatttttcgtggtcgtaaccgcacacccaggccgcaccgcgggaacgcgatggcaaacgatcgcctttgcaaatcgccataatgatgaatggcagcagcgggcaggcaatcagcagcaacgtgatcatcggttgagaaacggtggtgttagcaggctccagcggcagaggtacagcagcagagagcatcggcagtagccacggcgcagcaacaccgccaattacgcagcaaatcgccagtgccactacgcttacgctcatcaggagcggcgcacaggtggcgttttcggcttctttggtgcgcggcgcgccgaggaacgtgacgccatagactttcgccatacacatcaccgccagcgcaccggtaattgccagccccacagcgagcagcggccccagcagacgggcaacaaacgcgccactattgctcagtttgaaaaatgattgatagataacccattccccggcaaaaccattcagcggcggcagcgcagccattgccatcagcccgactaacatggcgatggagataaccggcattttcttgccaataccaccgagtttttcgatatcgcgatgaccggtacggaaccagacgctccccgccccgaggaacagtacgcttttgaacaggctatggttaagcagatggtacagaccaccgaccaggccaagagcaatcagcgccggttgttcgagcgcgatacccgttacgccagcgcccagccccagcaggatgatgccgatattttccagggtgtggtaagccagcaggcgctggatgttgtgctccaccagcgcatacagaccaccgacaaacgcggtgatcatgccgagcaccagcagcgcgatcccccaccacagcggtgcattaccgcccagcagtgacagggttaaaatgcccagcaggccaattttcatgactaccgtagaaaacaacgcggcagctggcgcagaggcgttcgcatgtgcctgcggcacccagccgtgcagcggaataatcccggccagcaggccaaagccaatcactccgagcagccagatatcggaaccgagcggcagctgttgcatacgcatatccagcaggcgcagatccagcgtgccgtaacgctgccacagcagccagcaagcaatcgccagcagcagagtgccaagacgccccagcgcaaaccacagtttgccctctttgctgttgctggtgaggaacaccgcgcacagggccatgatttcggccattaccacgaacatgccgaggttgctggcaatgacggcgcagacggcggcagccatcaacatattgatctgcaagccgttgcacttcacctgcgcgtggcgatgccagtcaatgttgtagaggctgacaaacagaccgcacagaccgagcgtaatcagccaaatcgcgttaagcggagagatttgcacatcgtagcttaccagcgacagcgcaccgctcacgccaaccgcgccagtcagtacagtgaagcccgcggctgccgtatacagactaccaaccgcgccgccaattccagctatccagccacttaacgctttttgaaaagaaaagagaaatgccagaacagcggcggcgacaaaccacgccacgccgctattgatcagggaaattgcgctcatttagcctctccactttgagcctgctgaaacaaggtgagatcgccaaagtccgtgttaaaggtcagctcacgcttacgtttgctgacgcgggcgatatcggtgttatccaccagatgcagggctttagtcgggcacatccgcacgcaggccggaccttgttcatcaaagctacaaaggtcacatttgacggcgatcgcgcgaatacctggcacccagtcaagcaatgtgctgacacgcgccggagcaggcggtgccggtggcgctttcggggtattggcgtttgccggaatatccagcggacggctgccggaaaattcaattgcgccaaacgggcaggcgatgccgcacagcttgcagcttacgcacaggctttcattcaactgcacggccccatcgacgcgggtgatggcgttaaccgggcagaccaccgcgcagggtgcatcttcacagtggtgacagagctgcggcgcagattctttttcattcagcatcactctcaggcgcggcattgattgcaggccgtgctggcgatgcgtctctgaacaggcggcctcacaagtgtggcagccgatacagagcgtggagtcagcaattacaaaacgattcaccaggcattcctcaggtgattgtcatttttgacgaaaacatgccgatgaaatgtcattttcgacactcatcgacacgcccatccccaaacaggcgtaacgcctgcaaaacgggcaaagcctcagctcatgctgccgggctttgtccctttaccagttggcttaaattcaccggcacattgttttcaatagcggtgtataagctgtcgtaaacgccagcgattttttcgagatagtgttccagaacctgttcgcgatcgcggatgttgaccttgccatcaatcatgccgtcaatgctcagttgcgcctgcgcaatccgctgtttgtcttcgccatcttttgtttcgacgtaatactcgatggtgtggctgttaaagccatccgccagggtgacgtaaatgcgaaaatgttcaaaaaggacgaaacagagttctttgtccggcgcgcagctcatggcgtgatgcaggcgcgctttcgataacgtgatcccctgaaccagcgaattgcagtagatgtgccactggtcctgtaggcgacgatgccgctgtgcgatgtaatcggctttctcgcttatttcccaaatagtcattgtcaggttacccgtttaacagagatgccagctttaagcattttttgtgccaacttttaatttattgttattaaagagatttttaagctaaagatgaatttcgtcgccgtgtcgacgtgtcatttcgacatcatcgacattattcaccgcagggataatcaacactggcacaattattgcttgtagctggcaatagttaatgggaggcgatatgcacgaaataaccctctgccaacgggcactggaattgatcgaacagcaggccgcaaaacacggcgcaaaacgcgtaactggggtctggctcaaaattggcgcattttcttgtgtcgaaaccagctctcttgccttttgttttgatctggtttgccgcggcagcgtggcggaaggttgtaaactgcacctcgaagaacaagaggccgaatgctggtgtgaaacatgccaacagtatgtgacgctactgacccagcgcgtccgccgctgtccacagtgtcatggtgacatgctgcagattgtggcagacgacggtttacagattcggcggatagaaatagaccaggagtgagcgatgtgtacaacatgcggttgcggtgaaggcaacctgtatatcgagggtgatgaacataaccctcattccgcgtttcgtagcgcgccatttgccccggcggcacgcccgaagatgaaaatcaccggcattaaagcgcctgaatttacccccagccagactgaagaaggcgacctgcattacggtcatggcgaagcgggcactcacgcaccgggcatgagccagcgtcggatgctggaagtcgaaattgacgtgctggacaaaaataaccgtctggctgaacgcaaccgcgcgcgctttgctgcccgcaagcaactggtgctcaacctggtttccagccctggttccggtaaaaccaccctgctgacggaaaccctaatgcgcctgaaagacagcgttccgtgcgcagttattgaaggcgaccagcaaaccgtgaacgatgccgcacgcattcgcgctaccggcacaccagcgattcaggtgaacaccggtaaaggctgccatcttgacgcacagatgattgccgacgccgcaccgcgtctgccactggacgataacggtattctgtttatcgaaaacgttggcaacctcgtatgcccggccagcttcgatctcggtgaaaaacacaaagtggcggtgctttccgttaccgaaggtgaagacaaaccactgaaatatccgcatatgtttgccgccgcctcgctgatgctgctcaacaaagttgacctgttgccgtatctcaactttgacgttgaaaagtgcatcgcctgcgcccgcgaagtcaatccagaaattgaaatcatccttatttccgccaccagcggcgaagggatggaccagtggctgaactggctggagacacagcgatgtgcataggcgttcccggccagatccgcaccattgacggcaaccaggcgaaagtcgacgtctgcggcattcagcgcgatgtcgatttaacgttagtcggcagctgcgatgaaaacggtcagccgcgcgtgggccagtgggtactggtacacgttggctttgccatgagcgtaattaatgaagccgaagcacgcgacactctcgacgccttacaaaacatgtttgacgttgagccggatgtcggcgcgctgttgtatggcgaggaaaaataatgcgttttgttgatgaatatcgcgcgccggaacaggtgatgcagttaattgagcatctgcgcgaacgtgcttcacatctctcttacaccgccgaacgccctctgcggattatggaagtgtgtggcggtcatacccacgctatctttaaattcggcctcgaccagttactgccggaaaacgttgagtttatccacggtccggggtgcccggtgtgcgtactgccgatgggtagaatcgacacctgcgtggagattgccagccatccggaagtcatcttctgtacctttggcgacgccatgcgcgtgccggggaaacagggatcgctgttgcaggcaaaagcacgcggtgccgatgtgcgcatcgtttactcgccgatggatgcgttgaaactggcgcaggagaatccaacccgcaaagtggtgttcttcggcttaggttttgaaaccactatgccgaccaccgctatcactctgcaacaggcgaaagcgcgtgatgtgcagaatttttacttcttctgccagcacattacgcttatcccgacgttgcgcagtttgctggaacagccggataacggtatcgatgcgttcctcgcgccgggtcacgtcagtatggttatcggcaccgacgcctataattttatcgccagcgattttcatcgtccgctggtggttgctggattcgaaccccttgatctactacaaggcgtggtcatgctggtgcagcagaaaatagcggcccacagcaaggtagagaatcagtatcgtcgagtggtaccggatgccggtaacctgctggcgcaacaggcgattgccgatgtgttctgtgtcaacggcgacagcgaatggcgcggcttaggcgtgattgaatcttctggcgtgcacctgacgccggattatcaacgattcgatgccgaagcacatttccgcccggcaccgcagcaggtctgcgatgacccgcgcgcgcgttgtggtgaggtattaacgggcaaatgtaagccgcatcaatgcccgctgtttggtaacacctgtaatcctcaaaccgcgtttggtgcgctgatggtttcctccgaaggagcgtgcgccgcgtggtatcagtatcgtcagcaggagagtgaagcgtgaataatatccaactcgcccacggtagcggcggccaggcgatgcagcaattaatcaacagcctgtttatggaagcctttgccaacccgtggctggcagagcaggaagatcaggcacgtcttgatctggcgcagctggtagcggaaggcgaccgtctggcgttctccaccgacagttacgttattgacccgctgttcttccctggcggtaatatcggcaagctggcgatttgcggcacagccaatgacgttgcggtcagtggcgctattccgcgctatctctcctgtggctttatcctcgaagaaggattgccgatggagacactgaaagccgtagtgaccagcatggcagaaaccgcccgcgcggcaggcattgccatcgttactggcgatactaaagtggtgcagcgcggcgcggtagataaactgtttatcaacaccgctggcatgggcgcaattccggcgaatattcactggggcgcacagacgctaaccgcaggcgatgtattgctggtgagcggtacactcggcgaccacggggcgactatccttaacctgcgtgagcagctggggctggatggcgaactggtcagcgactgcgcggtgctgacgccgcttattcagacgctgcgtgacattcccggcgtgaaagcgctgcgtgatgccacccgtggtggtgtaaacgcggtggttcatgagttcgcggcagcctgcggttgtggtattgaactttcagaagcggcactgcctgttaaacctgccgtgcgtggcgtttgcgaattgctgggactggacgccctgaactttgccaacgaaggcaaactagtaatagctgttgaacgcaacgcggcagagcaagtgctggcagcgttacattcccatccactggggaaagacgcggcgctgattggtgaagtggtggaacgtaaaggtgttcgtcttgccggtctgtatggcgtgaaacgaaccctcgatttaccacacgccgaaccgcttccgcgtatatgctaataaaattctaaatctcctatagttagtcaatgaccttttgcaccgctttgcggtgctttcctggaagaacaaaatgtcatatacaccgatgagtgatctcggacaacaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcgtcgcgtgaaaaagacacccccattaaatatgaagacgaaactgttctggcacacggtccggtacgcagcattttgtcgcgccctgatacgctgcattgcagttacgaagaattttgtgaaacctggccgcagctggacgcaggtgggctatacccaaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagccgcgtcgttaacaatgtcgactatgagttgttatgccgggaacgcgataacttccgcatcctggtcgccatcaccaacgcggtgctttcccgcctggatatggacgaactggtcagcgaagtcgccaaagaaatccattactatttcgacattgacgatatcagtatcgtcttacgcagccaccgtaaaaacaaactcaacatctactccactcactatcttgataaacagcatcccgcccacgaacagagcgaagtcgatgaagccggaaccctcaccgaacgcgtgttcaaaagtaaagagatgctgctgatcaatctccacgagcgggacgatttagccccctatgaacgcatgttgttcgacacctggggcaaccagattcaaaccttgtgcctgttaccgctgatgtctggcgacaccatgctgggcgtgctgaaactggcgcaatgcgaagagaaagtgtttaccactaccaatctgaatttactgcgccagattgccgaacgtgtggcaatcgctgtcgataacgccctcgcctatcaggaaatccatcgtctgaaagaacggctggttgatgaaaacctcgccctgaccgagcagctcaacaatgttgatagtgaatttggcgagattattggccgcagcgaagccatgtacagcgtgcttaaacaagttgaaatggtggcgcaaagtgacagtaccgtgctgatcctcggtgaaactggcacgggtaaagagctgattgcccgtgcgatccataatctcagtgggcgtaataatcgccgcatggtcaaaatgaactgcgcggcgatgcctgccggattgctggaaagcgatctgtttggtcatgagcgtggggcttttaccggtgccagcgcccagcgtatcggtcgttttgaactggcggataaaagctccctgttcctcgacgaagtgggcgatatgccactggagttacagccgaagttgctgcgtgtattgcaggaacaggagtttgaacgtctcggcagcaacaaaatcattcagacggacgtgcgtctaatcgccgcgactaaccgcgatctgaaaaaaatggtcgccgaccgtgagttccgtagcgatctctattaccgcctgaacgtattcccgattcacctgccgccactacgcgagcgtccggaagatattccgctgctggcgaaagcctttaccttcaaaattgcccgtcgtctggggcgcaatatcgacagcattcctgccgagacgctgcgcaccttgagcaacatggagtggccgggtaacgtacgcgaactggaaaacgtcattgagcgcgcggtattgctaacacgcggtaacgtgctgcagctgtcattgccagatattgttttaccggaacctgaaacgccgcctgccgcaacggttgtcgccctggagggcgaagatgaatatcagttgattgtgcgcgtgctgaaagaaaccaacggcgtggttgccgggcctaaaggcgctgcgcaacgtctggggctgaaacgcacgaccctgctgtcacggatgaagcggctgggaattgataaatcggcattgatttaactgcaaattgccggacagatctgcctgtccggcatactattcatgaggttttttcggacgatatttttccggcagttctggcaccggacgcttgtcatcgatgagatgacgcacggttaagatcggatgacgccacagcattctcggcccggcccaacgcataatctgtttcatctcttcacgctttgcaggctggtaacagtgcaccggacactgcttacaggctggtttctcttcgccgaacacacatttatccagccgcttttgcgcgtaaacaaacaacgcctcgtaatgctccggctccgctgacgcctgcgggcatttcgcttgataaagatcgatcatttttttaatcgtcagtttttcacgagagatacgcttgccggacatgctgcctccacctcattaagatgtatttatattacatcttaatcttaaagggcactatgactccaaagaagaagggttagccaaccgatacaattttgcgtacttgcttcataagcatcacgcaaaagctgcaaaacagcatctttcccggaaccagcatcaagaactcgccgttcgcttcttcccctgaaatgattaactccggtatcatgtgcgccttatgtgattacaacgaaaataaaaaccatcacaccccatttaatatcagggaaccggacataaccccatgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaataacaattcccgatagtcttttgctatcgggaatattaacgacaactgacgaataaaataaaaacaccctgtataataggaaagcttattttacagggtaaaaccatgccatctacacgctatcaaaaaatcaatgcccatcactatcgccatatatgggtcgttggtgatattcatggtgaatatcagttattacaatcccgcttacatcaactctcttttttccccaaaatcgacttacttatttctgtcggcgataatattgatcgtggaccggagagtcttgacgtcctgcgcctgctaaaccaaccctggtttacgtcggttaaaggcaaccacgaagcgatggcgcttgaggcattcgaaactggcgatggcaatatgtggcttgccagcggtggtgactggtttttcgatttaaatgattcagagcaacaagaggcaatagatctgttgctgaaattccatcaccttccacatattattgaaatcactaacgacaacataaaatatgccatcgcacatgcagattatccggggagtgaatatctctttggtaaagaaatagcggagagcgaattactctggcctgttgatcgtgtgcagaaatcgcttaatggcgagttacaacaaataaacggcgctgattattttatatttggacatatgatgtttgataacattcagacgttcgctaaccagatttatattgataccggatcgccgaacagcgggcggctgtcattttataaaataaagtagtctcatgcttcttctgtgaagcatgagtaacccggtgttattgcaggccattattcatttttcgctaccagcaaagagagatcctgcttcaccagcgcgcgactggcactctccggcaaaccgtcgtctgtaataatctgatcaaactcgcttaatggtaacgccagccatgtcgccacctgaccatatttcgtcgcatcacagaccaaaactcgctggcggctggcactggcaatcgcccgtttcaccgtgactttatcttccgctggcgtagaaatcccccgcacactccatgacgatgcagaaataaaagcctgatcaatcatcaggctgcgcagcatggtcgcagcggcttccccgacacaggaacggttttcccgacacactgcaccgccagtgtgaataattgtgcaattactgttgtcgagcaagtagtccgcaataacgaaatcgtttgtgaccacagtcagtgactccatgtgaatcagatgctgtgctatcgctaacgtggtcgttcccgcatccagatagatacaacttcccggctgaacaagacttgccgccagcttgccaatagccgctttttgcgtcattgccagcgcagtttttacctgatgagaaggttcatgcgccacgcgtcccggagactggacgcctccggacaccagcacaacggctccctgctgctccagtttttgtaaatcccgacgaatggtcatatgtgacacattcattctgtccgttagttcagcaatactgacaatgcctttttcagctaccatctcaaggatgatttggcgacgctctacgggtatcaacttttgctccttcctttgtcctgctgacattctacgctatttgcctgcgaaacgtgcgcggcgcaactaacgcttagttcacataaaataacacacaatgttaatttatgtgaatcagatcaccataccgttatcttccagcgcttatattcacaatatcaaacaaaatatcacttaaattaacaaggagagcagatgaaaacgggatctgagtttcatgtcggtatcgttggcttagggtcaatgggaatgggagcagcactgtcatatgtccgcgcaggtctttctacctggggcgcagacctgaacagcaatgcctgcgctacgttgaaagaggcaggtgcttgcggggtttctgataacgccgcgacgtttgccgaaaaactggacgcactgctggtgctggtggtcaatgcggcccaggttaaacaggtgctgtttggtgaaacaggcgttgcacaacatctgaaacccggtacggcagtaatggtttcttccactatcgctagtgctgatgcgcaagaaattgctaccgctctggctggattcgatctggaaatgctggatgcgccagtttctggtggtgcagtaaaagccgctaacggtgaaatgactgtcatggcctccggtagcgatattgcctttgaacgactggcacccgtgctggaagccgttgccggaaaagtttatcgcataggtgcagaaccgggactaggttcgaccgtaaaaattattcaccagttgttagcgggcgtacatattgctgccggagccgaagcgatggcacttgcagcccgtgcggggatcccgctggatgtgatgtatgacgtcgtgaccaatgccgccggaaattcctggatgttcgaaaaccggatgcgtcatgtggtggatggcgattacaccccgcattcagccgtcgatatttttgttaaggatcttggtctggttgccgatacagccaaagccctgcacttcccgctgccattggcctcaacagcattgaatatgttcaccagcgccagtaacgcgggttacgggaaagaagacgatagcgcagttatcaagattttctctggcatcactctaccgggagcgaaatcatgatcaagattggcgttatcgccgatgattttaccggcgcgacggatatcgccagttttctggtggaaaacggtctaccaacggtacaaattaacggtgttccaacaggtaaaatgccggaagcaatcgacgcactggtgatcagcctgaaaacgcgctcctgtccagtggttgaagccacacagcaatcgctggcggctctgagctggttgcaacagcaaggttgcaaacagatctatttcaaatactgctctactttcgacagtacggcgaaaggtaatattggcccggttaccgatgccttaatggatgctctcgacacgccgtttacggtcttctctccggccctgccggtcaacggacgtacggtttatcaggggtatttgttcgtaatgaatcaactgctggccgaatccgggatgcgccatcacccggtaaatcccatgaccgacagctatcttccccgtctggttgaagcgcaatccacagggcgctgcggcgtcgtttcggcacatgttttcgaacaaggtgtggatgccgttcgtcaagagctggctcgcttacagcaagagggctaccgctacgcggtgcttgatgcgctgaccgaacaccatctggaaattcagggagaagccttgcgcgatgccccactggtaacgggcggttctggtctggcgattggcctggcccggcagtgggcgcaagaaaacggtaaccaggctcgcaaagcagggcgtccgctcgctgggcgcggcgtagtgctctccggttcatgctctcaaatgaccaaccgccaggtagcacattaccgtcaaattgcaccagcccgtgaagttgatgtggcacgctgcctctcaattgaaactctggccgcttatgcacacgaactggcagagtgggttctgggccaggaaagtgtacttgctccactggtttttgccaccgccagcactgacgcattggcagcaattcaacagcaatacggtgcacaaaaagccagtcaggcagtagaaacactgttttctcaactagcggcgcggttagcagcggaaggcgtgacacgctttattgtcgcaggcggtgagacctccggcgtagtcacacagagcctgggaataaaagggtttcatattggcccaaccatttccccggcgtgccgtgggtaaacgcactggataagcctgtctcactcgcccttaaatctggcaacttcggtgatgacgcctttttttcacgagcccaaagagagtttttatcatgagcgatttcgcaaaagtagagcagtctttgcgagaggagatgacgcggattgccagttcattctttcagcgcggctatgcaaccggttcggctggcaatctgtcgctgcttttacctgacgggaatttactggcgacaccgacaggttcatgcctgggcaatctcgatccgcagcggctttccaaagtcgccgcggatggcgaatggttaagtggtgacaaaccctcgaaagaggtgctctttcatctggcgctgtatcgcaacaatccgcgctgtaaagcggtggtgcatttgcacagcacatggtcgacggcgctttcctgcctgcaagggctggacagcagcaacgttattcgtccgttcacaccatacgtggtgatgcggatgggaaatgtcccgctggtgccttattaccgaccgggcgataaacgcatcgcacaggatctggcggaactggcagcagacaatcaggcttttttactggcaaatcatggcccagtggtttgcggtgaaagcctgcaagaagccgccaacaatatggaagagctggaggaaacggcaaagctgatttttattctcggtgaccgcccgatccgttatctgaccgcaggtgaaattgcggaattaaggagttaatgcaatgcctcgttttgcagctaatttatccatgatgttcaccgaagtgccttttattgaacgcttcgccgcagcgcgaaaagccgggttcgatgctgtggaatttctgtttccctataactactccaccctgcaaatccaaaagcaactggagcaaaaccatctgacactggcgctgttcaataccgctcccggagatattaatgcgggggaatggggattatccgcccttcccggacgtgagcacgaagcacacgcagacatcgacctggcactggaatatgcattggcgctcaattgtgaacaagtccatgtgatggcaggcgtcgtgcccgctggcgaagatgctgaacggtaccgggcagtatttatcgataatatccgctacgctgccgaccgctttgcgccacacggcaagcgaatattagttgaagcactcagccccggcgttaagcctcattatctcttctccagccagtatcaggcactggctattgttgaagaggttgcgcgagataacgtgtttattcaactagatacttttcatgcgcaaaaagtagatggcaacctgacgcatttaatccgcgactacgccgggaaatatgcgcacgtacaaattgccggactacctgatcgacatgaaccggacgatggagaaatcaactatccgtggctgttccgcctgttcgatgaggtgggatatcagggctggatcggttgtgaatataaacctcgtggcctcaccgaagaagggcttggctggtttgacgcctggcgctaattcgttaaatccctaattacaacgtacccatacatccccccatctacggatggggtaggttaactataactttcagacagggtttcccatgtccacaattacattgttatgcattgcgttagctggcgtaatcatgctgttgctgctggtcatcaaggcaaaggtacaaccattcgttgctttgctcctcgtcagcctgttagtcgcacttgcggcaggtataccggcgggcgaagtgggtaaagtgatgatcgccgggatgggcggtgtgcttggttccgtcactattattattggtctgggcgctatgctggggcgtatgatcgaacactctggtggtgcagagtcactggctaattatttcagtcgcaagttaggtgacaaacgaactatcgctgcgctgactctggcagcgttcttcctcggtattcccgtcttctttgatgtcggctttattattcttgcgccaatcatttacggttttgccaaggttgccaaaatatcgccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtaggggttgttggctactttgcagcgaaaataatcaataagcgccaatatgcgatgtcagtagaagtactggaacagatgcaactggctccggccagtgaggaaggcgcgacaaaattaagcgataaaataaatccaccgggcgtcgcgctggtcacctcgctaattgttattcctatcgcgattatcatggcgggtacggtttccgcaacactgatgccgccttcgcatcccctgcttggtacgctacagctgatcggctcaccaatggtagctctaatgattgcgctggtgctggcattctggttattggctttacgtcgcggctggagcttacaacacaccagcgacattatgggctcagcgcttcctactgcggcggtagtgattttggttactggtgctggaggggtatttggcaaagtgctggtggaatcgggcgtcggcaaagcccttgccaacatgctacaaatgattgacctgcctctgttaccagccgcatttattatttcactggcgctgcgtgcatcgcaggggtcagcaaccgtagcaatactgacaaccggcgggttactctcagaagcggtgatgggattgaatccgattcagtgcgtattggtgacgctggcagcctgctttggtgggcttggtgcgtcacatattaatgactcagggttctggattgtgaccaaatatctggggttgtcggtagcagacggtctgaaaacctggacagtgttaacgaccattctcggttttaccggattcttaattacctggtgcgtatgggcggtaatttgaccttaataaaaaggtccgatgggcatcggaccttttattgtgcacagaaaaggccagcctcgcttgagactggcctttctgacagatgcttacttactcgcggaacagcgcttcgatattcagcccctgcgtttgcaggatttcgcgcaaacggcgcaggccttcaacctgaatctggcgaacacgttcacgggtgaggccaatttcacgacctacatcttccagtgttgccgcttcgtaccccagcaaaccgaatcgacgtgccagcacttcacgctgtttggcgttcagctcgaacagccatttgacgatgctctgcttcatatcgtcatcttgcgtggtatcttccggaccgttctctttttcatcggccaggatgtccagcaacgctttttcggaatcaccacccagcggggtgtctaccgaggtaatgcgctcgttaagacgaagcatacggctgacgtcatcaactggcttatccagttgctctgcgatctcttccgcacttggttcatggtccagcttatgggacaactcacgtgcggttcgcaggtaaacgttcagctcctttacgatgtgaatcggcaaacgaatagtacgggtttggttcataatcgcccgttcaatcgtctggcgaatccaccaggttgcgtatgttgagaagcggaaaccacgttccgggtcaaacttctctaccgcgcggatcagccccaggttgccctcttcgataaggtccagcaacgccagaccacgattgccataacggcgggcaatttttaccaccagacgcaagttactctcgatcatccggcggcgagaggcgacatctccacgcagtgcgcgacgcgcaaaataaacttcttcttcggccgttaacagtggtgaataaccaatctcaccaaggtaaagctgagtcgcgtccaacacacgctgtgtggctccctgcgataacagttcctcttcggccaaatcgttatcactgggttcctgttctactaaggccttttcgtcaaaaacctcaactccgttctcatcaaattccgcatcttcatttaaatcatgaactttcagcgtattctgactcataaggtggctcctacccgtgatcccttgacggaacattcaagcaaaagcctggttccgccgatttatcgctgcggcaaataacgcagcgggtttacggatttccccttgtaacgaatttcaaaatgcaagcgtgttgaactggttccggtgctacccatggtcgctattttttgccccgccttaacttcttgttgttcccggaccagcattgtgtcgttatgggcgtaggcactcaggtaatcatcattatgtttgatgataatcagattaccgtagccgcgcagcgcgttaccagcataaacaacgcggccatctgcggtcgcgataattgcctgtcctttgctgcctgcgatatcaatccccttgttgcccccctcagaagcgccaaaggtttcgatcactttgccctcagtcggccagcgccaggtggagataggcgtactggttgatgtactgctgacagtcggctcggttgtgcttgctgttggtaccgttacaggcgctgtgaccgtggtcgcagttggcttgttgttcggcaacattttgttagcactctgttcacccgaagactcagaatacgtaattgtcggttgcgacgcaacagcaacggtggaattttgtgcaggcttgatcacaactccttgctctgctgcgtcggcctgggtaatggcatttccgccagtgattggcgtaccggaagcattacccacctgcaaggtctgaccaacgttcagcgcgtatggtgcctgaatattgttgcgctgagcaaggtcacggaaatcgttgccagtaatccaggcgatatagaaaagtgtgtcgccttttttcacggtataggtactgccgctataactgcctttcggaatgttcccatactgacggttatagacgatgcgtccgttttccatctgtaccggctgctgagctactggctgcactggctggatttgcggttgttgagtagcctgaatttgtggctgctgcaccggctgaatttgcggttgctgcgctgtagacgtcgtccccattttcggcggcggcgtaatcaacataccagaattagtatttgcaggcgcattgccattaacggagctgaccggtgccggtggatttgaagtgtcagaacagcctgccagccatagcgaaaccagtgacaaagccgcaatgcggcgaacggtgaattttgggcttcccgcgctcatttatcccccaggaaaaattggttaataaccagtgacataattaccgtgcaaggcaccctactgaacactggaaaagatgttcacgatacgctgacctgcggcaaaataaccaggaaaaatccaggtatttcctcacgttttaagccagctcacccttcactaaagggacaaagcgcacggcctccacggtatcgataataaattcgcctccccgacgacgcacccgtttcaaatactggtgctcctcccctacgggtaagacgagaatcccgccttcgtccagctgcgtcattagcgcagttggaatttccggcggtgccgccgtaacaatgatagcgtcaaacggcgcacgtgcctgccaaccttgccatccatcgccatgacgggttgaaacattatgtaaatcaagatttttcaggcggcgacgtgcctgccactgcaagcctttaatccgttcaaccgagcaaacatgctggacaagatgcgccaggattgccgtttgatatcccgaaccggtgccaatttccagcacccgcgactgcggcgtcagctcgagtaattcggtcattcgcgccaccatatatggctgcgaaattgtctgcccctgacctatcggcaaagcgatattgtcccaggctttttgttcaaacgcttcatcaacgaatttttcacgcggcacggcggcaagtgcattcagcacctgctcatcctgaataccttgcgcacgtaattgatccagaagtgcttgtacgcgtctgcttaccattgcgtgccaactcccacgctgtttaaccagtctgaaaccacatcttgcgcgctatgcgcagttaaatccacatgcagcggcgtgatggagacatagccctcatctaccgcagcaaaatcggtccccggaccagcatcacatttaccgcccggcgggccaatccagtacagcgtattgccgcgcggatcttgctgcgggatcacctgatctgccggatgtcgtgtaccgcagcgcgtcacgcgaatacctttgatttgatccaagggtaaatccggaacgttaatattaagaatacgcccggtgcgcagcggctctttacacagtgcgcgcaaaattgaacaggttaccgccgcggcagtgtcgtaatgtttatgcccgtcaagcgagacggcaagcgccggaaaacctaaatgacggccttccatcgcggcggctaccgtaccggaataaataacatcatcccccagattcggcccggcgttaattccggacacaacaatgtccgggcgcggacgcatcagagcattcacgccaagatagacgcaatcggtcggggttcccatttgcacagcaatatcaccattttcaaaggtaaacgtgcgcagggaggattccagtgtcagagaatttgaagcgccgctgcggttacgatcgggggcgaccacctgaacgtcagcaaactcacgcaaggctttcgccagcgtttgtataccgggtgcatgtaccccgtcatcattactcagcaatatgcgcataatcacctgttgtgttgataagttccctgacaacgctggttgcaaaactacccgccggaagccagaaacggatctctacggtgacgtcatcccaccaattccagcttaattgttgcggatacagcagcatcgctctgcgcgcggcttcaactttttcgcgcaccagtaaagcttgtaattcagtttctgcggcgacagctgcttgttcgaatgccagcgcttcacgctgagttccccattcgccactgcctggcaatgcggcggttatcatcaactctttatcgttgacgcgacgctgtaattccgccagttcttcggtggttgcgacaaaccagctaccacgtccggctaattgtagcgcatcgccgtcaacaacttgattaacgtctgcttttttgaggcgctcagcaacaatctgattaaacaacgcactgcgggctgccgacaaccaaaaactccgtttattgcgatcgcgcaccggagtattggtttgcgcccagcgctgcgccccctgcaagttgctaccgccaatcccaaaacgttgggcaccgaagtagttcggtacaccttttacgcaaatatcgatcagacgttgttcaacgtcatcgcgattgctcacttcgcgcagaaccagggtaaaggcgttacctttcagcgcgcctaaacgcagcttgcgcttgtgccgcgcatactccagcacctggcagccttccagttgaaaggcgctcagatcgggcatttccttgcccggcacgcgagcgcataaccactgttccgtaacagcatgtttgtctttttgcccagcgaagctgacttcacgggcatgaattttcaggaatttcgccagtgcatccgccacaaaacgggtattgcagccgtttttgaggattctaaccagaatatgctcaccttcaccatcaggctcaaagcccaaatcttccaccaccacaaagtcttccggattggctttcagcagcccggtgccttgcggtttaccgtggaggtaagtgagattatcaaactcaatcattttgttgccttaatgagtagcgccaccgcttcacaggcaatcccttccccacgtccggtaaatcccagtttttccgtagtagtggctttcacgttaacatcatccatatggcagccgagatcttcggcaataaacacgcgcatttgtggaatgtgcggcaacatcttcggtgcctgagcgatgatagtgacatcgacgttgccaagggtataacccttcgcctgaatacgacgccaggcttcgcgtagcagctcgcggctatcggcacctttaaatgccggatcggtatccgggaacagcttgccgatatcccccagcgccgccgcgccaagcaatgcatcggtcaacgcatggagcgccacgtcgccatcagaatgcgccagcaatcctttttcgtaaggaatgcgtacgccaccaatgataattgggccttcaccgccaaaggcatgtacgtcaaaaccgtgtccaattcgcattatgtattctcctgatggatggttcgggtgaggtaaaactcggccagtgccaaatcttccgggcgcgtgactttaatgttatccgcacggccttcgaccaactgaggatggaatccgcaatattccagcgccgaggcttcgtcggtaatagtcgcgccttcatttagagcgcgcgtcagacagtcatgtaacagctcacgagggaaaaattgcggcgtcagcgcgtgccataagccgttgcgatcaacggtatgagcaatggcatttttgcccggttcggcacgtttcatagtatcgcgcactggtgcggcgaggatcccccccgtgcggctggtttcgctcaacgccaacaatcgcgcgaggtcatcctgatgcaaacaaggacgagcggcgtcatgcaccaatacccactgcgcgtcgccagcggctttcagacctgccagcacggaatcggcacgctcatcaccgccatctacaacggtgatttgcggatgattcgccagaggaagttgtgcaaaacggctatcgccaggacttatggcaatgacgacacgtttcacccggggatgcgccagcagcgcatgcaccgagtgttcaagaatggtttgattaccgattgagagatattgcttaggacattccgtttgcattcgacggccaaatccggccgccggaaccacggcgcaaacatccaaatgagtggttgccatgttaattcccgggctgatttatcgattgttttgccccgcagactgtgcgcgcttcgacgcgtcaggcaccagacgataaaaagtttcgcccggcctggtcatgctgagttcattacgcgcacgctcttcgagcgcctcctggccgccattgagatcgtcaatttcggcaaaaagttgatcgtttcgcgctttaagtttcgcgtttgtagcttgctgtgccgccacatcatcattgacgcgggtatagtcatgtataccgttcttaccgaaccacagcgaatactgtagccagaccagaatagccagcaacagcagcgttagtttacccatcctgccccctgaaaaacggcatcatcatcccatgcatccgaagacgactctacatcctctgttggggataccgcgacaacgcgggcaaatgtaccacatttgtccattgttacgtatacccagggcgtgcagaacataatctcattattagttacggtttgaattatgaacagaggagacgggaaagtacaaattagcccagtagccacataaacagtgcgccaaacataatgcctactgtcaccagggtgaaaacaatactgtagcgtagctttccgtccatcaatgaatgcagcgcaatccccaccactaccgcgacgggcatcagcgccagaaagaaaggccaggtgtagataaagaagaacagcgtgttagagccataaatcaacatcggcatcgccagcgcaaataaccaggagataaaaccgaccacggcaccaggcagtgaccatgtggtttcttcatcctcagtaaggctgtcgttatttgttagtgtaatgttatggctattacgcatatttgatcctgttactttgacgaaccgggcatggaaacccggtggtgtctcaggatctgataatatcgttctgtctcaacagatctaataattgctgtaccaaatttgttactaattgttcaccattgagatgaatttctgccgattcaggcgcttcgtaaacggaatctattcccgtaaagttgcgcagttcaccggcacgcgctttcttatataagcctttgggatcgcgggcttcgcaaatcgccagcggcgtatcgacaaacacttcgataaagcgcccttctcctacgcgttcgcgaaccatctggcgttcggcgcggtgtggcgagataaatgcggtcagcaccaccagtccggcttcaaccatcaaattcgccacttcaccgacgcgacggatattctctttacgatcggcatcgctaaaaccgagatcgctgcataatccgtggcgaacattgtcgccatccagcagatacgtactgacgccgagtttatgtaacgcctcctccagcgccccggcgaccgttgatttaccggacccggagaggccggtaaaccacagcactacaccacgatgaccgtggtgtagctcgcgttgttgcacagtgaccggatggctatgccagacgacgttttcgtcatgcagcgccattatttatcccccagcaaatcgcgcgcgccccagtgcggaaagtggcgacgaaccagagcattcaattccagttcgaatgcactgaattcagatggcgcagcagttgcctggctaactggctcgtgcaccataccggcacccacggtcacattgctcaggcgatcgataaaaatcagcccacccgtcaccggattttgttgataacgatctaacaccagcggctcgtcaaaagtgagatccacgaggccgatcccattcagtggcaggttttcaacttcacgctgggtaaggttattaatatcaacctgatagcgaatgccatcaacacgcgcgcgcgtcttcttaccggcaattttgatgtcgtaactctgccctggagaaagcggctgttccgccatccataccacatccaccgacgcgctctgcaccgccggtaacgcttcgtctgccgccagcagcagatcgccacggctgatgtcgatctcatccgtcagcaccagggtgatcgcttctccggcaaaggcttcttcgcgatcaccatcaaaagtcacgatccgcgcgacgtttgattccacaccagagggcagcactttgacacgttgcccgacttccacgcgaccggatgccagcgttccggcgtaaccacgaaaatcgagattcgggcgattaacgtactgcaccgggaagcgcattggctgagcatccaccactcgctggatctccacggtttccagcacttcgagcagtgtcggaccgctgtaccacggcatactttcactttgcgatgccacgttgtcgccttccagtgcagagagcggcacaaagcggatatccagattacccggcagctgcccggcaaaggtcaaataatcttcacgaatacgggtgaacgtctcttcactgtaatccaccagatccattttgttgatcgccacgaccagatgtttgatccccaacagtgtggagataaaactgtgacgacgggtttgatcgagcacgcctttacgggcatcgatcagtaagatcgccagttcacatgtcgatgcgccagtcgccatattgcgggtgtactgctcgtgccctggggtgtcggcgataataaatttacgcttctcggtagagaaatagcggtaggccacgtcaatggtgatgccctgttcgcgctcagcttgcaggccgtccaccagcagagccagatccagcttttcgccctgggtgccgtgacgcttactgtcgttatgcagcgatgagagctgatcttcgtagatttggcgggtatcgtgcagcagacgaccaatcagagtacttttgccgtcatcgacgctaccacaggtcagaaaacgcagcaggcttttatgttgttgcgcaatcatccaggcttcgacgccgccttcattggcgatttgttgtgcaagtgcggtgttcatcttaaaaatacccctgacgttttttcagctccatagaccccgcctggtcgcggtcaatcacgcggccctgacgttcactggtggtggaaaccagcatctcttcgatgatttccggcagtgtttgtgcatttgactccaccgcaccggtcagcggccagcagcccagcgtacggaaacgcaccatccgttttttaatcacttcgcccggttgcaggtcgatacggttgtcatcaatcatcatcaacataccgtcgcgttccagaaccggacgttccgcagcgagatatagcggaacaatgtcgatattttccagccagatgtattgccagatatcctgctcggtccagttagagagcgggaagacgcggatgctttcgcctttgttaatttgcccgttgtagttgtgccacagctccgggcgctgatttttcggatcccagcgatggaagcggtcacggaaagagtaaattcgctctttagcgcgggatttctcttcgtcacggcgcgcaccaccgaaggcggcatcaaaaccgtatttgttcagcgcctgtttcaggccttcagttttcataatatcggtatgtttcgcgctgccgtgcacgaatggattaatccccatcgccacgccttccgggtttttatgcaccagcagttcgcagccgtaggctttagcagtacgatcgcggaactcatacatctcgcggaatttccagccggtatcgacatgcagcaacgggaaaggcagcgtacctggataaaacgccttgcgcgccagatgcagcatgacgctggaatctttaccgatagagtagagcatcaccggatttgagaattctgccgccacctcgcgaataatgtggatgctttccgcctccagttgccgcaggtgagtaagtcgtatttgatccataaccgttcctttgcaataccgctattttcttgccatcagatgtttcgactatagggagcgtaagagaacgaatgaaattaccaattagaatgagtagttccttaacggaataacgatttggcaaagctaatatcaaaaagtgcttaaggcaccggatttcgggcgtttaggaagatttgaaattgttttagcgcagcggcagtttcatactatggcggtaaaaaaatttgcatggtatttaaggactcactatgttttccgcattgcgccaccgtaccgctgccctggcgctcggcgtatgctttattctccccgtacacgcctcgtcacctaaacctggcgattttgctaatactcaggcacgacatattgctactttctttccgggacgcatgaccggaactcctgcagaaatgttatctgccgattatattcgccaacagtttcagcaaatgggttatcgcagtgatattcggacatttaatagtcggtatatttataccgcccgcgataatcgtaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctgacgttacaaggaatggatgataacgccgcaggtttaggtgtcatgctggaattggcagaacgcctgaaaaatacgcctaccgagtatggtattcgatttgtggcgaccagcggcgaagaggaagggaaattaggcgctgagaatttactcaagcggatgagtgacaccgaaaagaaaaatacgctgctggtgattaatctcgataacttaattgttggcgataaattgtatttcaacagcggtgtaaaaacccctgaggcagtaaggaaattaacgcgcgacagggcgctggcaattgcgcgcagtcacggaatagccgcaacgaccaatccgggtttgaataaaaattatccgaaaggcactgggtgttgtaatgacgcagaaatattcgacaaagcgggcattgctgtactttcggtggaagcgactaactggaatcttgggaataaggatggttatcagcaacgcgcaaaaacacctgccttcccggcgggaaatagctggcatgacgtaagactggataatcaccaacatattgataaggctcttcctggaagaatagaacgtcgctgccgtgacgttatgcggataatgctacctctggtgaaggagttggcgaaggcgtcttgatgggtttgaaaatgggagctgggagttctaccgcagaggcgggggaactccaagtgatatccatcatcgcatccagtgcgcccggtttatccccgctgatgcggggaacaccagcgtcaggcgtgaaatctcaccgtcgttgccggtttatccctgctggcgcggggaactctcggttcaggcgttgcaaacctggctaccgggcggtttatccccgctaacgcggggaactcgtagtccatcattccacctatgtctgaactcccggtttatccccgctggcgcggggaactcccgggggataatgtttacggtcatgcgccccccggtttatccccgctggcgcggggaactctgggcggcttgccttgcagccagctccagcagcggtttatccccgctggcgcggggaactcaagctggctggcaatctctttcggggtgagtccggtttatccccgctggcgcggggaactctagtttccgtatctccggatttataaagctgacggtttatccccgctggcgcggggaactcgcaggcggcgacgcgcagggtatgcgcgattcgcggtttatccccgctggcgcggggaactcgcgaccgctcagaaattccagacccgatccaaacggtttatccccgctggcgcggggaactctcaacattatcaattacaaccgacagggagcccggtttatccccgctggcgcggggaactcagcgtgttcggcatcacctttggcttcggctgcggtttatccccgctggcgcggggaactctgcgtgagcgtatcgccgcgcgtctgcgaaagcggtttatccccgctggcgcggggaactctctaaaagtatacatttgttcttaaagcattttttcccataaaaacaacccaccaaccttaatgtaacatttccttattattaaagatcagctaattctttgttttcaaacaggtaaaaaagacaccaaccttaaaccatccaaatctaccggggtacgcctgtttaacccaaatgtctggaactcaaatcccgtttccgtattcgttgcccatgccatcactacattgccttcttccgccagtccagctatttgttcccagatcatttcacgaatttttgcggatacatcacctacatatacccctgcacgtacctccaacaaccagatggctaatctgcctcgtaagcgcggaggtacattttcagtgaccacgaccaacatactcatttcagctactccgatggcctgcatctcccagtgaaacaggaagcggaatggcaacaggctgtgcatcttcaggtggggccggcggttgtatttctccagcggcaagcacgtcctctataagcggaatcaatttggctaatgttttactactgcgaaaaatatccctgcacgccaaacggacttcccggtccggctcaccagggttacgacgcgctatctcaaaagctttcggtacaacagtgtcaaatttaatgatgtctgcaatatcgtaaacaaaggaaagaggctttcctgtatgcacaaacccaatagctggtgcataaccagctgcaagtatcgccgcttcagttacgccgtataaacaggaagttgcagcgctaatgcattggttgatcgtatcgcccttttcccagtctttcggatcgtagcgacgtccattccatgtcacgccgtattgcttcgccagaagtgcgtaggttgcccgcacgcgactgccttctatacctctgagttgctctacggagcgccgggcaggcgcaggttctccaaaccgaagttcaaacattttacgtacgaccttcagacgcaaatcttcatccagagcaagttttgcctgatagagcagcttatctgaacgcgcacctccaggctgaccagaagcataaacacgaacgcccgcttcccccacccataccaacaatgttccaacttgcgcagccaggcgtacagctgcatgcgaaacccgtgtaccaggttccagcatgatgcaggcaaccgagccaacaggaatatgagtgcggatccctgtcttgtcgataagtacaaacgcgccatctattacatcgatctgcccatattgcagaaagatcatggagacgcgatctttgagtggaatgggattaaggggaagccaggtcattttattacacctcaatcacagtggagccaaagatagcaagccacatcccatcgatttagctggcccaataccttgctgtacaagatctattaacgctggcgcgtcgttgatggtgagcacaccttcaaagcaaaccgtttggatctttccacttttaccatcaccagaaaaatactgtggccgttccgatatgggatgcacatcttcaacgcgcgccgcattgcccaatttacgttgcaaccacgcgatttgttctgcttcttttattaacggaacccgacagcgtttaatattccctttactgtccaggcgcttttgattgtcgagaatagttttgatcggatttgcccgaagccgaaaatagagtggaacaccaacctgaagttgaaattcaacctgtttagttttaatgactgtcgcaacggcagttgaaacaggcatttgcgctgactgcaataaaacatgacagccttctggtgtgtttcgcttctcaacatgaaaaagaaaatcacgagcagcatccggtctgtttggaaataaatgccataatccctggtgaagttggtaaagatccctgctccaggccctggcaatgatgactttactgagatacatccatacctcctttaatcacataccattctcgggaagcaaattgtcgaggcaaggtgatcatcggttcgtcgcgcgccgtaaattttaaatgatgccctgtaactgattcctcactatatatatcgccgccaacgggctcataatttaatagcgccttctgaggatccgatgcctgacatgtccccaaaaaaagcgggtgtgttagtgggcaacttctccgccccaggtaaggtgtataccgaggctttaatactgctttttcaagttctgagataaccatcgttgcatggggtgttaaccagagagcgacggtaaaggaggcatcacataaatattcgcgccatgtttgaatcgtttcatgacttttcaaaccacggtaatcttctcgcgctccaaggactgtatggtaatcacgcaaccccgttacagacacacgacgatcgtcaagaatgagttcatcgcagcgcactgcaaattgcacactctctgataacgcctgtaatgaagaagtatcatcacgttggatcccaagacaagccccgagtagccctaataacccgcttcgggtcggaaatcttccggtaggtcgcgttccttcaaaggtcggctgcccccaggcttgcattggcccagcaagccgcaagatcaaataagatctcatgttcacgcctcgccattattacgaacccaggattttaactgttctaaagtaggcatttgtttaacttgagcagtaattgggtctacatcagataagctgaattgcgcagcagctccgttcagaccatatccattggcaacgcgatcccaatattgattaaacgcctgtatagacggttgcaaaaagccatctttcgctttaaccgctttttcaaaagcatttgccatagaaagtggcatatcggagaaattaaccattaccatatccgcagggttaaaagcggcataagtacgctgttttgctccagggacctctgttgccagcatatgaacaacatgggttgcaatttccagagcctgctccctggaggcaccacctaaattttcctgaagttgagcgaggttaatgttggcataacgataaaaaacacccgatgaaaattcctgagttcccagatgtgcagaaccttgttcctgtaaatcatctacagcggtgaaccagtcaatatcagaatcaacctgatgagtagtgatcgcatgcgcaatggacattgcaccatcaacttttcccaactcagtcatcatgccgctggttgccattcttccactaagcgcaatatcaacaccctgctgtaaattcacacgtatggcggcaatatcttccttaagaactttgagcagctttttatcatccagattatcagcctctgcttttgcaacctgctcacagaaccaggctatttctcccacaacccagggagtaaccgcatcggcagaaatcttttcggcttcatcaactgatttaccggagagcagcgctaatgtcttatcgatgattttttggtcaaaacgttcaccaagtttttgccgaagaacatcacgtaattgtgcaagatgaatggttctgagactggattcaccaatattttgtgcgtaataaccacttttacgcatcgcacgtttaaggctttgacttgaaattcttactcgtcttttgccgccgaaaatagcgtctttctgcatgttcatatcgtcgcggttcagacatgaagggctgtgagagatcagaacatgaatattgataaagttagacatagaaaggtttccttacgcatttttgtttgtggtcaatacaaaatcttccagaagttgctggcgttcgcgctttccccaccaggtcaacatcctggccattaatggccagtcaagtacgggttcggcgtgagtaagtaatcgacgtaactggaccatatcggctgttctgtcagcccgaattaattgaaagatacggcgctcgttaattcttccactattggctaaagctcttcccaacgagatacctgttgtttgctccgattttttgtcctgatgtcggatgacattctttcctgcgctcaggcaaaacaccatgcgcaaaagagcctgctggtgacgtgggttttcccaaccaaaaggttgcaccagcctataaaacgcagggatatcgcgtaattcatcaggttctgaaacacgtctaatttgcgcacatgatccattatccagttgttgccaggctcgatataaagccattgcatcaatttcatcagccatttgatggccctccttgcggttttaactcccgtaaatgtttgtatagcgtggcgcgggcaagcgctaatgtgcttattaatttaggatgatgtgcatagggagctacagattgattaaatagcatttcacacaattgatgaagtttgtctcgtaaatcagctattacctcatcagcctgggaaaaattaacattcgccagtacatcgggaattaataattcactctgtcgatagaaatgcctttctgcagtctcatgaacagagactccggcccctttgaagtctttatttttaaacccttctgcaaaggtatataacgccttgcgtaaggctgttttatatcccaaaccaacagtcactatttcgtttatcacattgccgtattgttgccacccctgattaaacatcaacacatcatgacgccgttcaagaatagatgcttgattattacgatatccccccataatcaattcaagaggactttgcggcgcaatatttctgaattgattcacaaccgccgccacgcgatttccattttcattttgaataatcttatctaccacaactcggctgatttgtgtccatgatggtgcggaggtggtgaaagcaagaaatttttcctcaacctcccctttcttgactgttaccagacaaggggaatgcggatggggccatagcccattaactgtaaaggtaaatttttccttaagaaaaccggtataacgcaaattgctttcctgtccacagcaagaacatttaccaatcccaatgggatcgcataattcaatatgcgctggttgccagaatagaccacggacaaacccaattgacgaagcaggtatagactcattggacttgataggtttaatccaggtaggttggttttccgtatgtgattcattaggaaattgtttttgaagacgaggtaatgtgaggacattgagtaacaccgttgaacgaagatcgatcccacgtacgaacgttgttacaggtgttcctccacgtaaaccgcttttaaaaccaccaccaaaacctggtgcctgattcgcctggttgaataacgcaatcgcagtgcatccaccacataatgcttcaccctgccccggttgattgacaaatgcacaattcgtcgcgccgcttaccccagccaacagtttttccattggagtcacatcatttgctttgacacctttggtctgcataaagggatgttctgcgtgattaaggtagaacatatctatccacggcgcgatgagttgttgaaactcatcttcagtgagcggattcattatgcgatgtcgaaattcaacgtcatcttttgccggggcgataatttgcccaatgcaaaccagcagtgctaaagcggccagttccatatcgtcacggggcaaacttaatcgccactgatctctactgcagtatagcgattgcagatttatgatttggactttccccccgtttcgcgggcgtacagggatccagttatcaataagcaaattcatttgttctccttcatatgctccgacatttctcctgcatttctatacgtcggcacacttccgttatcggtaaaaacaaagaaaaaatacggcgtaattaattcaataatcacattcactgcaaaaatatattcattggtttaatacaattaacctatacatatattaagatgtgttgaattgtttaaagacaataatgcatgcatttcaaatctgcaagttattcgttttattattaaagaaacttttagttataataattaccatgaattttattacataaaatattcatactgtgaatataaaatctcataccgggaaattaaaagaagatgtacattgtgcaccttccctacttaagtagggataaaccgttattggtcttattatcgtcattgataacaatcattcccgaagttatttgggatttgcagggatgactctggtcatcccttcatcccctgtataggtaataacaatactgttaccctgccagacccatccatccagattctgtttcccttccagccaaagtaacccatcttcatctactacttcagaaaaactacgtttccaggtgaagggtacattgacgcgattaagtgcaagcgcctcatactgctgttcatgacttaggtcctcgtagacctggccatcgagcagttgtttacctgaagacgtttgtacataaggcaataatggcaggctcatttccccatccctcgttaccgcaagaatggtttcatcgttatcctgcaagctatattcttcagcccactgcaggaccttgcgagccttgaaccttttttcacactcggcgctttcaaatttatccatgccattgccgacccattctggctcatccatttccgcatcatcgtaaatgctatccagccattgccggtaagcatcagggaaaaataaggatgctccattaagctcctcaatatgttgctgcgtccgccacatgactctaacgttgctataaatatgctcatgtcgtccgtaaccctcgccatcaggcagcaaaatggtggcaacaggaatctcaaaaccagcgggacgatatttgcgatgatggcgatgtaaacggcccaatcgttggaaaagcaaatctgcaggacaatgctgagtaattaaccaatcaaaatcaacgtcgagtgattgttccacgacctgggttgcgacaagtatccgtccaacatttcgcttcccatttttgccgaaattgctaataactcgattctctttttcacgacgatcgttcagcgtaaagcgcgcatgaaacaaatctatatctacttgcgtgttatttagctcctttagccgttggtagcatacttgtgcaacgtcaaccaaattgcaaataagacagacctgtgcacccgcgtttgccgctgcgatcattcgctctaacatcgtaaggtcaggtaacatgtcagctaaacaaataggttctggctgaatcgaaaagcggggcgggagttgttctggatgagctagcagatcaaaacgttgcgcaccattcacacctcgccagttaatgagtggatatgcggagttattttccactggatctgtatgcagaccataagtatccagaagtttctgtttttgtttcattggtagggttgcggaaagaagaataacactccctcccacatcagcctgagccttgagcactgcctccagcaagccgttcatataggtgtcgtaagcatgaacttcatcaacaattaaaacacttcgaccaattcccaaaccacggataaagcggtgtttaactggcaataccgatatcaacacctgatcaatcgtgcaaacgccgatttgcccaagaaacactttcttattgctttgtgacaaccactgacaacactgaacccacgcttcttcttgcccctgttcagtaatcgcgcgtgattttattgattgaaagaggtggttaaaccgtgaattgccatgagcaagaataagatttggggatgaaaataagtggctcgcgctcgcttccattctcgtaagcatagcattcgcggtagcttgtgttgggagggcaaaaataacactatccgcaatttgttgatcaataagtttccaagcataggccagcgctgtttccgttttaccggagcctgtaggtgcctctattaccgtcagcccgggagctactggaagagcatcaactaacacctgtaattgtctgggttgatagccattgtccagtagtgcatgaacaccttcataacatcgcttatttgatacaagtccactcaactccaatacccggctcgcatcctgctgtcggtcctggaaatacgttctcagagcatttatgtcggaaggcgcatcctcattaaacagaaaggtattcgttgtagtccaggagcctaaccagtcagcaagcgagcaaaaacctgctaacagtgatgaacaatcaggtggtatatcgtttatagataaccccgctggcgttaaaaataatgcttccagtacagatatccactcctcacgagcctgtttatcttgcgcagcataagatgccagagaagctggcatttcccaacgcgacttatcttgatcctgggaatgtaatataaaaccatgatgtcctgtaacggcctctacccatggaaaccaggactcataaggatgaggagcggcatcaaaaaaactgaaaaaatccccgagagattgctctgaaagtgaatcctggttaaaccaatacagaccggctgcaccatgattaaatttacggcacatttgtgttgatggaccattaagtgatggcgttgcaggatttaatttcagccaactttctgctgatttatattggaatcgtatatcaaactttccaatatcatgaagagcaatgaaaaataacagccaggccttcaccctctgttttgatagcatttcatttcggcaaaaagtattttgcagtacgactgattgatcccaccagcaatctgcaacagcagcaacatcaaggcaatgataaattaacagatgaatatcatttcctttcgtcaagctttttgaggattttccccagtaatggcatatatatttaaaaggttccattaatagcctccctgtttttttagtattatcgatgatatcagcgggctatttttcgatgctgctcataaatatcgaattacagtgatatacacatgtcttgcctccctgcaaagaagagactaacattcgaattgtttgggttcgaacgctggcctcaggttgatagaaatatcgcctggggcttttgtccatctggaacctcgcgaatgcttaacgccagacagcctcaagcacccgacgccattctatacctgataattcttcccgcggcgttcacgtttaaaatcaggaatgctgctcgcaaaataaaaacgcccccatcatttctgacagaggcgtttaatttgtccggcaatatttacccttcgtgtaacccacattccctttttaagccaaagaaacgcgtttcttcttccgccatgccgggttcccatttacgggttgtatgggtatcgcccaccgataaatatccttcatcccataatgggtgatatttcaggccatgtttttgcaggtactgataaatagttcggttatcccagtcgataatcggcagcactttaaatacgccacgctgaattgccagcaccggtaaattggcacgactgccggattgttcacggcgcaggccagcaaaccaggtttgcgcattcagttctttcagagcccggttcatcggttcgactttgttgatgtcattgtacttttcaatgccttcaacgccctgctcccacagttttccgtagcgtgcttcctgccaggctgcgctttcggtagcacggtacactttcaggttgagcttgagtttgtccgttaactcgtcaataaagcggtaggtttccgggaacaagtaacccgtatcggtgaggatcaccggaatatccgggcgaatttgattcaccagatgcaggctcaccgccgcctgaatgccaaagctggaagaaagtacatattcaccgggcagattatccagcgcccaggctacgcggccttcagcgtccagtttttccagttcggcgttagtttccgccagcgccagaatgcgatctaccttcggcagttcgttcagggcgtttagatcgagtttggacatagattcctcactgtttgccttgcctgatgcgacgctcacgcgttcttatcaggcctacaagaccgggctgatggttaatcccacaaatcacgcgccggatcgagcaccgggcgaatgatgcccgcacgcaccgtaaagtcgccgaagccttcacccgcttcgcgctctttcgcccagcgccctatcagttcatcaagcgacgccaggatttccggctcggtgatgttttctttatacatccgtgggatacgtgtcccaatgcggttgccgccaagatgcaggttgtagcgacccggcgctttacccaccaggcccacttccgccagcatcgcgcgaccacaaccgttcgggcagcctgttacacgcatcacgatatgctcatcgctgacaccatgtttcgccattaaattatcgatgttgtcgataaaagacggcaggaaacgctctgcttccgccatcgccagcgggcaagtcgggaatgacacgcaagccatcgagttttcacgctgcggcgtgacggcattcattaacccgctctctttggcgatcttctcgatcttcgctttctcgctttccggtacaccggcgatgatcagattctggttcgccgtaatgcggaaatcgcctttgtggatcttcgcgatctccagcaggccggttttcagcggacgcgccggataatcaaggatgcgaccattttcgataaacagcgtcaggtgccagttatcatcaatgcccttaacccagccaatacgatcgcctcgtccggtgaactcatatggacggatcggttcaaatttgatccccgcgcgacgctccacttccgctttaaacgtctcaacccccacgcgctccagcgtgtatttggttttggcatttttacgatcggttcggttaccccagtcacgctgagttgtcacgacggcttcggccaccgccagcgtatgctccagcggcagatagccaaactcactcgcggtgcgggcgtaggttttcttgttgccgtgttcgatggaaagcccaccgcccaccaacaggttaaagcccaccagcttgccgttttcggcgatcgccacgaagttcatgtcgttggcgtgcagatcgatatcgttctgtggcgggatcactaccgtggttttgaatttacgcggcaggtaggtctggccgaggatcggttcttcatcagtagtggcgactttttcctggtcgagccagatctccgcatacgcgcgggtacgaggcaacagatgctcagaaatcttcttcgcccactcgtacgcttccgcgtgcagctgcgactcgtaagggttcgaggtgcagagtacgttacggttcatgtcgttagctgtcgccagcgcatcaagaccgaccgagtgcagcatctggtgcaccggtttgacgttctttttcagaatgccgtggaactgaaacgtctggcggttggtcaggcgaatgctgccatagatggtgttttcaccggcaaatttgtcgatcgcctgccactgtttagtggtaatcaccccacccggcagacgacagcgaagcagcatcgcgtggcgcggctccagcttctgttcagcacgttcggcgcggatgtcgcggtcatcctgctgatacatgccgtggaagcgaatcagcaggaagttgtcgcccttaaagccgccggtcagaccgtcgtttaaatcttccgcaatggtgccgcgcaggtagttgctttcatgcttcatgcgctcggcgtctgtcagttttccttcgaccactaaaggccctggatgtttttcgctcattagtagacatctcgctgataacggcgctctacgcgcagctcacttaaaaattcatccgccgcttcggtgtccatgccaccaaattcggcaatcacttccagaagtgcctgctcaacgtctttcgccatgcgattagcgtcgccgcagacataaatgtgggcaccatcattgatccagcgccacagctccgcgccctgttcgcgcagtttgtcttgtacgtaaactttttctttttgatcgcgcgaccaggcaagatcgatacgtgtcagcacgccatctttgacgtagcgctgccactccacctggtacaggaagtcttccgtaaagtgcggattaccaaagaacagccagtttttacctggcgcttcgtcggcggcgcgttgctgcataaaggcgcggaacggcgcaataccggtgcctgggccaatcataatcaccggggtttctggattggctggcaggcggaagttatcgttatgttcgataaatacgcggacttcgccctcttcttccacgcggtcagcgaggaagctggaggcaccaccggcacgggcgcggccttccacgtcgtaacgcaccacaccaacggtgacgtgtacttcgttctcgacttccgcctgcgaggaggcgatggaatacagacgcggcgtcagcgggcgcagcagattaattagcgcttcggcatcaagctgtgccggggagaaacgcaccatgtcaacaatcggcgtcgtcgcggcgtaatgctgtaacttcgctttatcgcccaccagcggcagcagtgtttcactgcgggtaagcgtggcgtaattctcaacaatgttggcggtgttgacggtcagttcgaagtgccactgtagcgcttcgttcagaggcaacgttttgccctcgacggtgacaggttcatcgcctttcagccacagcagttcgacaagttctttcaccagtgccggatcgttctgataccagacgcccagcgcgtcacccggctggtaacgcatgcccgagtcacctaagtcaatttcgatatggcgaacgtctttttcagagttacgcccggtaattttctggttaacagagaggctagccaccagcggcgcgtctttgctgtacgggctggtgtggatttcatttaccgcgccagtagcgacggattgcgaaggtgccgcgacaggcgcacgcgatttaagcgcatcaaccacgcgggcgcgccactcgctggcagcagcctggtattcaacatcggcatcgacacggtcgagcaggcgttcaccacccagttccgccagcttgctgtcgaaatctttcccggactggcagaaaaattcataagagctatcgccgaggctaaacacggcaaacgcggtgttttccagctttggcgcttttttggagaacaggaacttatgcagcgcgacggcttcttccggcggttccccttccccttgcgttgacgtcactacgatgagcagtttttcgctggcgatttgtttgaatttatagtcgcccgcgttcaccagcttaacgttcagttttgctgctaataaatcatcacgtaatgcttcagcaacccggcgcgcattgccggtttgcgaggcggagataatagttatacccggcatttctgcggctggcgctggcgtcgctgcaagcgcagcaggctgctgattgagtacgccccagaaatagccagaaacccaggcaagctgggtgggagttaaatcggtcgtggccgcctgaaggcgtgccagttgctccgggttcaacggaagcaacgcggaaggtgggacctgtgtcgtcatgcgtcgttatgttccagtaagcaaagctgtttctgcgccctgtcagcgcccataaaacagaagagaaggtaaggttaacggggcaaacggtgtggattaaagacgggatagcgataactaataaccaaatcgactaacctgttttagcaatagtctttaacaacaaaatagattaaccaacctaatgaaaaacaaatgaatttagccaatcattaagataaatcagcgattttgcgcaacaaagtcgttttagataatgcgaaaaaacagcctttccggtactctacggcggttttatcgtcctgtagagaaattatgatgtccaccacgttatttaaagatttcaccttcgaagccgctcaccgcttaccacacgtcccggaagggcataaatgtggtcgcctgcacgggcattcctttatggtgcgactggaaattaccggggaagtcgatccgcatacgggctggattatcgatttcgctgaactaaaagcggcgtttaaaccaacctacgagcgcctcgatcaccattatctcaatgatattccaggtctggaaaacccaaccagcgaggttttagcaaaatggatttgggatcaggttaaacccgttgtgccgctgttaagtgcggtgatggtaaaagaaacctgcaccgcaggttgtatctatcgcggcgaatgataagagtgtgtcggcggtcaatttcccttaagtaacgctatgttagggtgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtagcccgtaatctctggcgcgttgctgatgcgccgcacattgttccggctgactccgttgagcgccagacggcagaacggttgattaacgcctgtccggcaggtcttttttcgctcacaccggaaggtaacttacgtattgactatcgcagttgcctggagtgtggcacctgccgtttgctgtgcgacgaatcaacactacaacagtggcgctatccgccttccggattcggcatcacctaccgctttggataaataataaggataatttatgcccctcttacacctgctccgccagaatccggtgattgctgccgttaaagataatgccagcctgcaactggcaatcgattctgaatgccaatttatttccgtgttgtacggcaatatctgcaccatcagtaatatcgttaaaaagattaagaacgccgggaaatatgcttttattcatgttgatttgctggaaggcgcgtcaaataaagaagtcgttattcagtttttgaaactggtgaccgaggcggacggcattatcagtaccaaagcctcaatgttgaaagcggcaagagcggaaggttttttctgtattcatcgcctgtttattgttgattcaatttcgtttcacaacattgataagcaagttgcgcaatcgaatccggattgtattgagatcctgccaggctgtatgcccaaagtgctgggctgggtgacagagaaaatccgccaaccgctgattgccggtgggctggtgtgcgatgaagaagatgcgcgtaatgcgattaacgcgggtgtcgtggcgctttccaccacgaataccggggtctggacgttagcgaaaaaattactttgacgggataatcgtaaccaattgaatttggtttgatttgtaggccgcacgccacatccgacattcagcgcctgatgcgacgcttgacgcgtcttatcaggcctacaagtccccaggccagaaccgtaggcaggatcatccggcaacacgttattggcaatctgcgtgaatgtttgtcaccagtgcctccagcaccactttccagtcatcaaccacgccaacatctgcctgtgaaaataccgcagcgctggcgtcatgattaatcgccaccacaaacttgctattgcgtacgcccgccattaacgctgctgcgccagaagcgccaacaacaatacacacctcaggtgccagcagatgtccggaaataccaatcactttttcagcatcaacgccaccgttcatcactcgcgcccgactgtagcccacttcggctcccagcttttctgccagcatagcgatttcctggttatctgcctctccgccctgccccaccaccagcacccgtctggcctcagctaatgggtcgcgggtaacatttttcagatcctctgtgctaaccagccagtccggaagcgcacccgggacaatgttcagttgttgcattccagagggcaacgtggcgtttttcgctgctcccgcctgacgcgccagggaaaggcatagcgggcgtttttctgtttgcagcgtcgccgttagcgcatttccccagtgggatttgcgcacgcttacggttggaatatctaacgaagtcacctggcagatgcttgcaccatgtaaacgccaggccagccgggtcgacagttcatcgccaaacgttcccggcggaaagagaacaacgtccgcaggcgttcgctgccactgttccaccaacgcatccagcacctgttccgccactacaggctgaggttcaatctgccagtgcgccagggtacaaccgctgaaatcctgcgccgccagccagcttgctattgcggcattctcctgatttattgtcacaattgcgatattcatggctgcatcctttggcgtaaatagtcctgccatagcttttgagctttttctgctaccgtttgcccatcaatcagcgtcgctccgcgtcgttgctctgctcttgccagttgcagacactgcatcgctggcatttcggcagcaacagttttacggataatttctgctttccccgcagccattcgctggcgcattcccggtactggcaaggccacttcaccgcactgacgcacggcaatcaccgcaggcaagcgaacccggcaacaacgcaacccatgttcagtacgctgttcgagggtgataaacagcgcgtcgagagtgaaacgctccacctgggtgaagcagggccagcccagcatttccgccagcaaaaatggcgtttgcccattctgcccttcgctgctttggcagccggtaattatcagatccagcggattctgatgctgccattcggcaatatggcgagcgacaaattccggcgcaaagcgcagatctgccgccgtctccagcaatacagcttcctcaaacccaagagccatgagatagcgcagccagtgcaatgcccgttcatcccccatgctcaacgcggttaaagacatcggcgtaccgttttttctctgcgccaacagcagcgcggcagcggcctgttcatcagcaccgagtaaacttcgcagtagcgaaatatccggtccgcttttaccctgagccgccgcctgccactctttttccgccagcattccggcatccggttcggctttaaacgctaacagaatgttcattcgcacctcctacatttcccgccgccaccagcgggagggctttagtttctggtgcccatagccaggtcacaacaaaaccaaccaacaacactgtcgccaggagcaataaggtgacttgcattccccactgcgccagcacccacggcagcaggccagtacttaccgccgcgccaagtcgactcatggcagtggcaaaaccgacgcccagcgagcgaatgtcagtaggaaaactttccgcaggcaaaatgcccaccagattactgactgccgaaatggtggtgctgaagagaacaaaaagcagcagcgttaatgaactgccggaaggcaaacaggccatgactaccagcgttgccgccagcagcaaaaaacttcccagcaaaaatttgcgatgtgccagcaggtgcgtcagaactaatcccagcagcgcgcccacaattaacaacgcattaagcatcaggctggcagtcagcgcatcttccagaccaatagtctgggcgatagttggcagccaggtataaatcacaaaccatgggattacgaggcagacaaagaagacgctgttaaacgccgtgcgccgccagtaacgcgaagagaacaaggttttgatgtgtttatgggtcgccgttaccacttcatcgcccagtaaaacatggggaccaaaatagcgatgcacgatagcgtgagcttctgcaaaacgcccctggcgcagtagccagcgtggtgattctggcgttccccagcgtaataacgtaatcaacaacgcgggcagagctgccgatgccagtagccagcgccaggcctccgggttttcggaaataaagtgatgtccggcaatacttgccagcacatagcctacggtccacaccacgctgaatgcgcccagcaaaataccgcgatggcggcgcggggaaaattcagccagcaaggtgtgacctactgaataatcgcctcccagaccaatgccaatcaaaatgcgcagtccaataagatgctctggcgtggtggcaaaaaattgtaaaaacgaagcaagcgtaatcagcaaaaagctgaaggtgaagattttttgccgaccaatatggtcggagatccacccaagaaccaggctgccaaggaacaaaccaaggagcgccgagccgccgatcattcccgccataaacggcgtcagttgcatggcgggcgtaagctgaataatggcgtaaccaatgacgccgagaacataaccgtcggtcaggtgtgcgccgaaagtgagcgcagcaatgcggcagtgaaaacggttaagcggtaaatcatccattcgcaccggtgaagtgttcatctttaccccttcattgtccggtaataagaacggcttctcgcctgagaagccgaaaaggcaacgccccgtcatcgcggaacgctgcctgacacattatttttcaatcggatagatagtacccgtattcataatgccattaggatcgaactgctttttcagcccttccagcaacgcccacgcgctgccgtgttccagtttgctccagtgaacgcgatgtttaccgataccgtggtggtgcaccatcgaaccgccgaggcgaatggtttcttcacagatgatcttgttgagcggattgtggtacttgtcgatttcctcttccggcttacagtcaacgacgttgtaatcgtagacgaagtacatgttggtgccgttctgatagctatgagaggaatgaccgcccagcatggtgatgtcgtcggcgtgcgggaactcagtacgaatacggttaataacgctttcgtagatttcgtggatgcagctccagcagccggatacttcggtggtaaagcccatgttgccggttttgaggatctgcacacgttcggcagccactttatccggtccccagttcaggttgttaaaccaggtttcgatcagcttgctgtccacgcgctggcattgcgggtagcgggcaacgatttccgcaatcccttcgcccgtcaccttcgcaatgcgagggttaccttcagccataaagatcagcacgcattttccgtcggcaaaatgggtgaagtgttgggtgccatcttcagcgtcatacaaacgagcgattgacggacgatacccttccaccatgatttcacgcaggatgttgaagccggttttcatgtcttccaggatatagccgtagaagaggttgttttccggggtgaatttaaagattttcactgttacttcagtgatatagcacaatgcaccttcgttgccgatgatgatgtgacgaatgtccgggccagccgcgcggcgtggcacgtttttaatgcgtgtgacggtgccatcagccaatactgcttccagaccaacgaccatatcttcgattgcgccgtagagtgtggagaactgcccgatacttcgggttgctaccaggccgcccatctgcgccagcggctttgactgcggagaatgccccgtggtgtaacctttttcacgcaacgcgttttccagcacttccagcggaacaccacattgcgccgtcgcctgcatattctcaatatcaatattaatgatttgattcatggcggagccgtcgagcaccaccgagttttctacaacagtttccagcccaccttcggtggcggaagcaccggtacgcggcacaccgttaattttgtgcgcattcataaaattcagcacacgggatacttgctctgtggaaccgagttttacgaccgctgccggaatcggcaaagtataaatgccatgaatatccggaaatttacgaaaacggtcaatactgtttttctttaatactgtttcatcggtaattacgcgatctgcaccaacaatttcctttagctggtcgacaatcgctgcgcgagataaagacatagtaattccttcctgataataaaaatggaataatcattaataagagaaaacagaaaccaccgttatgggttagcgcactaaataaccgccatcaaccactaataaatgcccgttgacataattcgatgccggacttgcgaggaatacggctgcgcccattaaatcctgagtatcgccccaacggtttgccggaatatgatcaagaacgcgctgattggtttctggattactgcgtgtcgccagcgtaatatctgttgcataatagccaggggcgataccatttacctgaatattatattgacctagttcatcacaataagctttggtgaacccggcaagagcatgtttagtggcagaatatgcaggtgaccattgtccacctaagtaagagaacaatgaacagatattaataattttgccgcttttctgcgggatcataatttttgcagcttcatagcttaactcgaatgcggcggtcaggttcacatcaatcatcggatcccagtcggcacgaccgaagtccagcaccttattcagcttacaaataccggcattgttaaccagaatatcaactgtaccgaaacgctcacagcaagcagcgataatcttctgcggcgcgccttctgcggtgatacccacctgcatgaagtccacctcaacaccctgtttttcaatcatttcctttgtttcgccgttatctttgacgaaactaggaataaagatatttgcgccagctttggccaacgccatggcaaatgcctggcctaaaccgctattcccaccggtaacaattgcggttttacctttcagggagaaaaaatccattgagaacgcattgagagattcgattgacatagttagctccaatttccgtaaggcaaaaaaaaagaaaggtaacttcccccgcgagagggaagttacctttctcattatctctggtaactggagataatttttagcataagggcataactgctaatgtgatcgtaatcacagtgtgatattcgtattgtcaaataattttaaaaagcagaagcgtgattactctcacacaacacctctgctttccatgttatttattatttcaattactagagacctgagaaaagtaatccacctgaaagggcggcttacttttctcttttttttgtctattacaaatgggaatacgatatgcaacacaactcatatcgccgttggataaccctcgcgataattagttttagcggcggcgttagtttcgacctggcttatttacgttatatttatcaaattcccatggcgaaatttatgggattcagcaataccgagataggtttaataatgagtacctttggtattgcggccattattctttatgcccccagcggcgttattgccgataaattttcacaccgcaaaatgattacttccgcgatgatcattaccggattactgggtctgttaatggcaacgtatccaccgctgtgggtaatgctctgtattcagatcgcctttgcgataacgacgattttaatgctgtggtcggtgtcgattaaagctgcatcgttgcttggcgatcatagcgagcaagggaaaattatgggctggatggaagggctgcgcggcgtcggtgtaatgtcgctggcggtgtttaccatgtgggtcttttctcgctttgcaccggatgacagcaccagcctgaaaacggtcattatcatctatagtgtggtttacatcttgttggggattctgtgctggttttttgttagcgataacaacaacctgcgcagtgccaataacgaagaaaaacagtcattccagcttagcgacatcctggccgttttgcgtatcagcaccacctggtattgcagcatggtgatttttggcgtcttcaccatctacgccattctgagttactccaccaactatctgaccgaaatgtatggcatgtcgctggtggcggcgagctacatggggattgtgatcaacaaaatattccgcgcgctgtgcggcccacttggcggcataatcaccacctacagcaaagtgaaatcccctacccgcgtgatccaaatcctttccgtactcggcctgctgacgttaactgccctgctcgtcacgaactctaacccgcaatcggtcgcgatggggattggcctgattttactgctgggattcacctgttacgcctcacgcgggctgtactgggcctgccctggcgaagcgagaacaccgtcttacattatgggcaccacggtaggtatttgttcggtgattggattcctgccggatgtcttcgtttacccaattatcggccactggcaagacaccctgcccgctgcagaagcctaccgcaatatgtggctgatgggcatggcggcgcttggcatggtgattgtctttacctttttgctgttccaaaaaattcgtactgctgatagcgcccccgcaatggctagcagcaagtaagccaggaaaattacaggagaaaaatcatgtcgaaaaaatacatcatagggattgatggcggaagtcagagcacaaaagtggtgatgtacgatctggaaggtaacgtggtttgcgaaggcaaaggcttattacagccgatgcacacgccagatgccgatactgcagaacatcctgacgacgatttatgggcatcattatgttttgccggtcacgatttgatgagtcagtttgccgggaataaagaagatattgtcggtattggtctgggatccatccgttgctgccgtgcgttattgaaagccgatggcacgcctgctgcgccgttgattagctggcaggatgcacgcgttacacgcccttacgaacacactaaccctgacgtggcatatgtcacctctttttcgggttatctgacgcatcgcttaaccggcgagtttaaagacaatatcgccaactattttggtcagtggccggtggattataagagctgggcatggagcgaagatgctgcggtaatggataagtttaatatcccccgtcatatgctgtttgatgtgcaaatgcctggcaccgtcctcggacatatcacaccacaagccgcactggcgacacatttcccggcaggactgccggttgtttgtaccaccagtgataaaccggtagaagctctgggggccggattactggatgatgaaacggcggtaatttctcttggcacttacatcgcattgatgatgaacggcaaagcactgccgaaagatccagtagcgtactggccgattatgtcttctattccgcaaacattgctgtatgaaggttacggtattcgcaaaggcatgtggacggtgagctggctgcgcgacatgctaggcgagtcgttaattcaggatgccagggcgcaggatctttcaccggaagatttactcaacaaaaaagcttcttgtgtgccgccaggctgtaatggtctgatgacggtgctggactggctgaccaatccgtgggaaccgtacaaacgcgggattatgatcggctttgattccagcatggattacgcatggatatatcgttcgatactggaaagcgtggcgctgacgctgaagaacaattacgacaatatgtgtaatgaaatgaatcactttgcgaagcatgtgatcattactggcggcggttcgaacagcgatctgtttatgcagatttttgccgacgtgttcaaccttccggcacgacgtaacgccattaacggttgtgcaagcctgggggcagcgattaatacagcggtaggtctggggctatacccggattacgcaacggctgtcgataacatggttcgcgtgaaagatatctttataccgattgagagcaatgccaaacgctacgacgcgatgaataaaggcattttcaaagacctaaccaaacatactgatgtgatcctgaaaaaatcgtatgaagtgatgcatggggaattggggaatgtggattcgatccagagctggtcgaatgcgtaagtgaggaaggccgggcgggaaactgcccggcctgaacatacctgaatggttatccccgctgacgcggggaacataagttcgacaacttaaaaaatgataacaagtccggtttatccccgctgatgcagggaacataataaaaactttaactagttcggtttatccctgtttttacaaggaatattaactacactcgatgtctttagaataaaagacaatacgaatcgcactttatcaattttcacttaaagtatgaactggatatctttattcataagaactattcatcaacagcgtatagaggcggttatgtaaaaccactcattagcctcaaaacaaagacaaacttccagatttattacttaaccaatgaataacaagcttaaaaaatatactgttattctaaagaaaaaattaacaggcattaattcaatattaaaaaaataatagattaaaatttcttaacgatttaagaatcatacaaataacactttgattaaatttaattttttgtatcgataattgtgaacctctctggcatggagaactattttgaacatgaggtgttacgtggatatgttgcttattacaagtactgctaatataaaaacttgagaaagagataacgggttatatggtggtttatccccgctggcgcggggaactcgacagaacggcctcagtagtctcgtcaggctccggtttatccccgctggcgcggggaacacctgttttcgcaaatctatggactattgctattcggtttatccccgctggcgcggggaacacgggcgcacggaatacaaagccgtgtatctgctcggtttatccccgctggcgcggggaacactggctctgcaacagcagcacccatgaccacgtcggtttatccccgctggcgcggggaacacgaaatgctggtgagcgttaatgccgcaaacacaggtttatccccgctggcgcggggaacacattacgcctttttgcgattgcccggtttttgccggtttatccccgctggcgcggggaacactctaaacataacctattattaattaatgattttttaagccagtcacaatctaccaactttatagtatcacacaaacaacacatccattatgttaaagagcacttaatccattgattaaaaaggtaaatatttaaaataactctatacaaactaaaatctaccaaactttaccgcaataattttcactccagcgaaaaattaatgccacagaatttgtagagaatgctaatgattagccctggatgggtaaaatggaggagttttcagaggcgacaaacaatataaatgagtagaagtctttacaggttccacccatttataacgcttataaatgtttaatcaggcaatatttagatatttatgtgtttgcatcgacaaacgccaattacgcgcaatgcaggtttcaatgcacaaacgtgtggcatcatccttttggctaatcggctgcagtgcaatgactcgcggtttatcatcggtcagcgttgccagtagttcatccagtgcttcaatatcgcgtacgcgccccactggatgcttgatttcgttggctcgctccagtgcctgtgacaacacttcatagccgccgcgcatgttcagctttggcgatacggtaacccaggtattcggtgtgcagcgtacctcatgagtaccactggtttcgatctggcagctaaaaccgttcttttcgagcagatcagtcagtggcagcaaatcatgaatgcaaggctcaccacccgtaatcaccacatgccgcgcggtgtatccctggcgaccaatgacagccagcaaatcttcactgctcgcagccccccacttatcactctctttggtcttcgccagaatgctgaaaagggagacttcccgatcctcaagcttttcccaggtgtgtttggtgtcgcaccaggcacagccaaccgggcatccctgtaaacgaataaaaatggcgggaacgccggtaaagtaaccctcaccttgcagggtctggaacatctcgttaatcgggtactgcatagcattctctgtgaagtggataattgttaattattgcagatcctgccacaacaatcatgtcttattaacattctgttacaggcaggtttaaagaaaaatgcgaaacatatcgttaataattaaagggagtaacgtattatgtcagaagaaaataaagaaaatggatttaatcatgtcaaaacattcaccaaaattatatttattttttctgtattagtttttaatgataacgaatataaaattaccgatgccgccgtcaatttatttatccagatttaatgagaaatttataatgcgctatttcatactaatgttcactttcgtatgttcctttgttgcagcccaaccaactattgtcccacaattacagcaacaagttacggatcttacgagtagcttaaactcacaagaaaagaaagaactgacgcacaagttagaatctattttcaataatacccaagtgcaaattgccgtattaattgttcccacaaccaaagacgagacaattgaacaatatgctacaagagtttttgacaattggcgtttaggagatgccaaacgtaatgatgggatactgatcgttgttgcctggtcggatcgcactgtccgcatccaggtaggttatgggctggaagaaaaggtaaccgatgctctggctggagatatcatccgtagcaacatgatacccgcatttaaacaacaaaaattagctaagggattagagctagctataaacgctttgaataaccaactcacttcacaacaccaatatccgactaatccttcagaaagtgaatcagcgtcttccagtgatcattattactttgctattttttgggtatttgcagtgatgttcttccctttctggttttttcatcaaggcagtaatttttgtcgcgcatgtaaaagtggagtctgtatttcagcaatctatcttttagatttattcctgttctccgataaaattttttccattgctgtattttccttcttttttactttcaccatatttatggtctttacctgtttatgtgtacttcagaaaagagcatctggtagaagttatcattcagacaacagcggttccgctggaggctcagatagcggcggatttagcggcgggggcggttcttctggaggtggcggcgcatccggccgctggtaactcaaccataaaaaatgccagcccggaggctggcatttttaaatcagataaagtcagtcttatgcctggcctttgatctctttacgaccgttgtacggtgctttttcgcccagagcttcttcgatacgaatcagctggttgtatttagcaacacggtcagaacggctcatagaaccagttttgatctggcctgcagcagtaccaacagccaggtcagcgatggtagcgtcttcagtttcgccagaacggtgagagataactgcagtgtagccagcatctttcgccatcttgattgcagccagagtttcggtcagagaaccgatctggttgaatttgatcaggatggagttagcgatacctttttcgataccttctttcaggatcttggtgttggttacgaacaggtcgtcaccaaccagctggattttgtcgcccagaactttggtctggtatgcgaaaccgtcccagtcagattcgtccagaccgtcttcgatagaaacgatcgggtactgtttggtcagttcttccaggaagtgagtgaattcttcagaggtgaacgctttgttgccttcgccagccagaacgtatttaccatctttgtagaattcagaagctgcgcagtccatcgccaaagtgatgtctttgcccagttcataaccagcagctttaacagcttcagcgataacagccagagcttcagcgttggaacccaggttcggcgcatagccaccttcgtcaccaacagcagtgttcatgcctttcgctttcagaacttttgccaggtgatggaaaacttcagaacccatgcggatggcttctttcacagttttcgcgccaaccggctgaatcatgaattcctggatatcaacgttgttgtcagcgtgctcaccaccgttgatgatgttcatcatcggaaccggcatagagtatttgcccggagtaccgttcagttcagcgatgtgctcgtacagcggcatacctttagcagctgcagcagctttggcgttagccagagatacagccaggattgcgttcgcgccgaatttggatttgttttcggtgccgtccaggtcgatcatgatcttgtcaatgccagcctgatctttagcatctttgccaatcagcgcctgagcgatcgggccgtttaccgcagcaacagctttggttacgcctttacccaggaaacgggatttgtcgccatcgcgcagttccagagcttcacgggaaccagtagaagcacctgacggagcagctgccataccgacgaaaccaccctccagatgtacttcggcttcaacagtcgggttaccacgggagtcgatgatttcacgaccgatgatttttacgattttggacattaggttttcctcaagtcactagttaaactgaaactccagacaaacaacgcgtacccagggtacgcgttgccgctctaacttttttacttacttcgcctgacgtttctggaactcgctggcggctttcacaaagcctgcaaacagcgggtgaccatcacgtggagtagaagtaaactccggatggaactggcaagccacgaaccacgggtgattcggaacttcgatgatctcgaccaactgatcatccccggaacggcccgcaacgcgcagacctgcatcttcaatctgtttcaacagcatgttgttgacttcgtaacggtgacgatgacgctcaacaattgtcggcgcattgtacagctggcgaaccaggctatcgtcaaccaactggcactgctgtgcgccgagacgcatggtaccgccgagatcgctcttctcgctacgaacttcaacgttgccgttttcatcgcgccactcggtaatcagcgccacaaccgggtacttacagtctggcacaaattccgtagagttggcgttctccatgttggcaacatggcgagcgtaatcaattaacgccacctgcatacccaggcaaatgcccagataaggaatattgttctcacgcgcaaaacgcgcggtcgtaatcatgccttctacgccacgatagccgaaaccgccaggtacgaggattgcgtccagacctttaaggatttcaacgccgcgcgtttcaacatcttgtgaatcgatcagtttgatgttgacgctgacacgattcttcagcccaccgtgtttcagtgcttcgatcactgatttataagcatccggcagttcaatgtacttgccgaccataccgatggtgacttcacttaccgggttcgcttcttcgaagataacctgttcccattcggacagattcgcttccgggcagtttaagctgaatcgtttacaaatataatcgtccagcccctgagatttcaacaggcccggaattttatagatggaatcgacgtctttcagagaaataaccgctttttccggaacattacagaacaatgcaatcttcgcacgttcgttcgccggaacagcgcgatctgaacgacaaatcaggatgtcaggctggataccgatggagagcagctcttttacagagtgctgagtcggtttggttttgacttcaccagacgctgccatgtacggcaccagcgtcaggtgcataaacagagtgtgctcacggccaatttcaacagccatctggcgaatcgcttcgaggaacggcaaggattcgatatcacctactgtaccgccgatttctaccagtactacgtcatgaccttcgccaccttccagcacgcgctctttgattgcgttagtgatgtgcggaataacctgcacggttgcgccgaggtagtcaccgcggcgttctttacgcagaacgtcagagtagatacgacccgtggtgaagttgttgcggcggctcattttggtacgaatgaaacgctcgtagtgccccaggtccaggtcggtttcagcgccgtcttcagtaacgaacacttccccgtgttggattgggctcatagtacctggatcgacgttgatgtacggatccagtttcatgatggtcacattgaggccacgggcttcaagaatggctgcgagggaggctgcggcaatgcctttacccagagaggatacgaccccgccggtcacaaaaatatagttcgttgtcatgctgaacctgagaagttaggttgaaaagacgatggaataaccaagacgggaaagcagtatacccgaacatgacctgtgccacaaactttcattatccctcctcttcgccagcgcactattgaaatcaggagtgagaaaatagcccctttggggtaaatgtttttgacgcaaatcaagcgcttgtcatttaaaaaatgacacaaatggcgcttgaccgcgtaattcccttagagatcaatttcctgccgttttacctgttgccagacttcttccattgtttcgaggtcaacacctgtcatttccagtccacgcgcggcaacaatacgctccacttcgcgaaaacgacgctcgaatttttcgttcgctttttgcaatgcgatttctgctttcgtccctaaatggcgagccagattaaccgtggcaaacagcaggtcccccatttcctcctccagtttagcctggtcgacaacagcctgccgcgcttcgtacatcacctcgtcgatctcttcgtagactttatcgactaccggaccaagcgtcgtccaatcgaagccaacgttggcgcaacgtttctggattttttgcgcacgcattaaagccggtaaactacgaggaatatcgtccagcgccgaatgctgcgctttctgcgcgcgctcttcggttttgatttgctcccaacgggcaagcacttcactactgttttcggcagaactatcagcaaaaacatgcggatggcgacgctctaatttatcgctaatagcagcgcaaatatcattaaagtcaaagcgcccttcttcctgagccatttgcgcgtaaaacaccacctggaatagcagatcgcccagttcaccgcgaagatcgtcaaaatcttcacgggcgatggcgtccagcacttcgtaggtttcttcaagggtgtaaggcgcaatggtggcaaatgtctgctctttatcccacgggcagccgttttccggatcgcgcaggcgctgcataatagtgagcaaacggtcgatttgattcattgaattgtcctgaaaattgcgggtctgtcaggtggaaacctgtgaccagaatagaagtgagttagtaacactacccaatcagtacgttaattttggctttaatgagttgtaattcctctggggcaactgttcctttcttcgttgctcctcttgcccgccaggcgatactttttacctgatcagctaacgctacgccatcacgttcctgaccggataaaacaacttcgaacggatatccttttgattgcgttgtacaaggaacacacagacacatacctgttttgttgttgtacatgaaaggactcaggacaacagctggacgatgtccagcttgctcgctaccttttgtcgggtcaaaatcaacccaaatcagatcgcccatatcgggtacgtatcggcttaccattaccagacttccttatctttcggctctccccagtcgatattctcgtggaggttttccggcgtgatgtcgttgaccagttcagcaagcgtaaatacgggctctttacgcactggctcaataattaatttgccatccaccaggtcaatcttcacttcatcatcaatattcagattgagcgcctgcattaacgtagccgggatccgcaccgccggtgaatttccccaacgctttacgctactgtggatcataaccctttcctcaaaccgctatcatatgtagatacagtatatatcaatctacattgtagatacgagcaaatttcggcctaactcccgtgcaaccgacgcgcgtcgataacatccggcacctggttgagtttacccagcacgcgccccagcacttgcaggttgtaaatctcaatggtcatgtcgatggtcgccagttgctgtttggtgtcgctacggctggcaacgccaagcacgttcaccttctcgttggcgagaatggtcgtgatatcacgtaacaacccactacgatcattagctaccacgcggaccaccagcgaatatccggcggagtagctctcaccccataccgcgtcaacaatgcgttctggcgcatgggagcgcagttccgccagttgttcgcaatcggcgcggtgtactgaaataccgcgcccctgggtaatgaagccgacaatctcatctccaggaatcggctggcagcagcgcgcgatgtggtgcatcaggttgccaacaccttcgactaccacgcgaccgttatctttactgcggttttgcggcgtgtagcttttttgctgaagttgcttcagcgcggcggcgtcctgctcttcggcactcggcttattaaattgcgattgcaggaagttcaccatctgattgagacggatatccccgccaccaatcgccgccagcaactcgtcgacatcattgaagttgtaacgcggcagcagatgtttttctgcttctttcaggctgatccccagatgttccagctcgtcgtcaaggatttgccgcccagccagaatgtttttgtcacggtcctgtttacggaaccaggcgtgaattttcgaacgcccacggctggttgtgacgtaaccgaggtttgggtttaaccagtcacggctggggttcggctgtttctgggtgataatttcaatctggtcgcccatctgcagctggtaggtgaacggcacaatgcgcccgccaatttttgccccgatgcagcggtgtccgacatcactgtggatgtggtaagcgaagtccagcggcgttgatcccgcaggcaaatcaacgacatcacctttcggcgtaaagacgtacacccggtcgtcaaagacctgactacgtacttcgtcgagcatttcgccggaatcagccatctcttcctgccacgcaatcagtttacgcagccaggcaatccggtcttcatgtcccgaacgtgcgccgccagcagccgcgccctctttatatttccagtgcgcagcaacacccaactctgcatcttcatgcatctgtttggtgcggatttggatctcaacggtttttccacccggccccagaaccacggtatgaatagactgataaccgtttggtttcgggttagcgacgtaatcgtcaaactcatccggcaggtggcgatagtgagtgtgcactatccccagtgcggcatagcaatcctgtaaacgctcggcgacaatacgtaccgcacgcacatcaaacagctcatcaaaggcgaggttctttttctgcattttacgccagatgctgtagatgtgtttcggacgaccatacacttccgctttaacgccttcagctttcatctcagcgcgcagatgaccaacgaactcttcgatgtagtgttcgcggtcgagacgccgttcatgcagcagtttggcaattcgtttgtattcggttggatggaggtaacggaagcagtaatcttccagttcccatttcagttgtccgattccgagacggttagccagcggtgcgtagatgttggtacactcttttgccgccagtacacgttcatcttccggcgcatcttttacttcgcgcagatgagcaatacgctccgccagtttgatgactacgcagcgaaaatcatcgaccatcgccaataacatccggcgaacgttatcgacctgttcggaggaaacagaatcagtgtgcgtcgctttcagctggcggatcgccgccatatcacgcacgccgtgaataaggttaacgaccgacttaccgacgctctcacgcagcacatcttcgctgactacgttggcatccgccagagggaaaagcagcgccgcccgcagcgtgtcaatgtccatacttaatgtcgagaggatctccaccatctcaacaccacgccacaataacagactggcatccggatgcccctgcgtctgttgcagacaatacgcccaggtttcggctaagcactcacacgacttctggctggtaatacccagacttgcgatccatttttccggatcaaattcaccagccttattgatatgtgcacttcttaccgcaaccatcgtcctctcctttagggaccagacctgccgaaatcggcaaatcgcaactatttaacgcgcgagaaaagtaccatcgattccagatgtcccgtgtgtgggaacatatccagcatcgccagtcgcgcaatggtatatcctgcttttaataacgcttcgctatcccgagccagcgttgcagggttacaggatacataaactatacgaataggttccagttttataatttgctgcataacacctgcggcacctgctcgcgccgggtccagcaacactttatcgaagccgtttttcgcccacggctgctttgtgacatcttcttcaagattttcgtgataaaacgtcacattctgtaagccattaagacgcgcattctgctggcctttttccaccagcgccggaacaccttctacaccgaccacactggcagcttgtgtcgccaatggcagtgtaaagttgcccataccgcagaacagatccagtacgcgatcttcaggttgcacatccagccattccaacgcacgcgctaccattttttggttcacacccgcattgacctgaataaaatcgcgcgggctaaaagttaagcgcaacccgtttgagtcataccagggcatctcaccagagacggtttcgagtatctcactatcgggggcgagatacagatccaggccttcagaatgcgaaaagcgttccagtttttcgcgatctgccgaacttagcggtgcggtatggcgcaaaatcatcagcgtgccgctggttgcctgtaccagttcaacatgaccaagatggcgcatagcttgtaagctgcccagacatgccctgactttgggcagcaatgcttcaagttggggcgctaaaatggggcattgtttgacgtcgacaatgtcactggagcccgctttgcgaaaccccatctgaagttgctgtgttttcggtaagtagttcagacttaaacgcgcgcgacggcgatagccccagggaacatcggcgatcacttcagagacatcgtgtttcattaatcgggcgagtgccgcacttttgcttcgctgctgtaaatccacgctggcgtgttgttgctgacagccaccgcatacgccaaaatgaggacagcgtggcgtttcgcgttccgggctatcgcttaaccggcgtacgactttagcgcgggcatactgttttttatcttcagtaacagtaacttccgcgttttcctgcggcaataatccggggataaatagcgttttgccgttatgtcgcgccacgccctgaccaaaagagtcgaggtcgttgactgaaacggttatgatctgacgcgtcgtcgtgcgtcgttttgcagagtagaattgcgccattggcgagactttctcaatttaacagtgtgaccttaattgtcccataacggaactccatgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagcattattgagccgcttgcagtttctactgaatatggcatgagcctgcaaaatcgcgaatctatcggtcagttaataagcgtactgcatcgtcgccattccgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatattatgatcctccgcacgccgattatttctgagagttactcccccgacgaatcgcccagtagcgatgccaaaaatagtcaaaatatgttgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggatttatgctcggcgagctggatatgctgaaaaacggtatcaactcgatggcaatgtcgctggctgcttatcacgaagagatgcagcacaatatcgaccaggcgacgtccgatctgcgtgaaacgctggagcagatggaaattcagaacgttgagttagatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagcaggtaagctgattctggaaagtattccattcccactacgcagcacgctggatgaagtcgttactctgctggcacattcttctcacgataaagggttagaactgacgctcaatattaaaagcgacgtgcctgataacgtgatcggcgacccgctgcgattacagcaaatcatcactaacctggtggggaatgcaattaaattcaccgagaatggcaacattgatattctggtagaaaaacgtgcgctgagtaataccaaagtgcagattgaagtgcagattcgggataccggcattggtattcctgaacgcgatcaatcgcgcttattccaggccttccgacaggctgatgccagtatttcccgccgtcatggtggcaccgggctggggctggtgattacacaaaaactggttaatgaaatgggcggcgatatttcgttccatagccagccgaatcgcggttcaactttctggttccacattaatctcgatctgaacccgaacattattatcgaagggccatccacccagtgcctcgcaggtaagcgcctggcctatgtcgaaccaaactccgcagcagcgcaatgcacgctggatattttaagtgaaacgccgctggaagtggtttatagcccaacgttctccgcgctgcctcccgcgcattacgacatgatgttgttaggcatcgcggtgaccttccgcgagccgctaacaatgcaacatgagcgattagcgaaagcggtatcgatgaccgatttcctgatgctggcacttccttgccatgcacaagtcaatgctgaaaaactcaagcaagatggtatcggcgcgtgtctgctgaaaccattaacacctacacgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttgatcttaatggatattcaaatgccggacatggatggcattcgggcctgcgaactcatccaccaactcccgcatcagcaacaaacgccggttatcgcggtaacggcgcatgcaatggccgggcaaaaagagaagctgcttggcgcagggatgagcgattatctggcgaaaccgattgaagaagagcgattgcataatttgttgttgcgctacaagcctggcagcggtatttcctctcgcgtcgtgacgcccgaagtcaacgaaattgtggtgaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtgccacgtatgaagaatctctgccaactgatcgaacaacagctacgtagcggtactaaagaagaagatttggaaccggagctgctggaactgttggacgagatggataatgtcgcgcgcgaagccagcaaaattctcgggtaatggatgtcttgtcgagtagcaatcggctttttatgacgctggtttcagattggtgacaaagtgcctgtgtttatgccggatgcggcgttaacgccttatccggcctacaaaaccaattaaattcaatgaattaaaaaatgatgtagacctgatacatagcacaacaggctattttgcgtttagcatcagtctcaaaccggctccagatagagccggttttggttttctgtcttaacgcaccatgcacgggcgcttgttatcgaacgtccagccaggaatcagatactgcattcccatcgcatcgtcacgcgcgccaagcccgtgtttctgatacagctcatgggctttcatcacttgatccatatcgatttctacacccagccccggtttttctggcacctgtaccagcccgcctttgatctcaaacggttctttggtcaggcgctgattgccttcctgccaaatccagtgcgtatcaatagcagtaattttacccggtgcagcggcggcaacatgggtaaacatcgccagggaaatatcgaagtggttgttagagtgtgaaccccaggtcaggccaaattcatggcacatttgcgccacacgtaccgaaccttgcattgtccagaaatgcggatccgccagcgggatatcaacggattgcagggagagcgtatggcccatttgccgccagtcggtggcgatcatattggttgcagtcggtagacctgtcgcgcgacggaactctgccatcacttcacgcccggagaaaccttgctccgcaccacacggatcttctgcataagccagcgaacctttcaggtatttaccgattttaatcgcttcgttcagcgaccaggcaccgttaggatcgagcgtaatacgcgcctgcgggaagcgttgcgccagtgccacaatagactcggcctcttcttccccggccagtacaccgcccttcagtttgaaatcgttgaagccatatttttcatatgccgcttccgccaggcgcaccaccgcatccggcgtcatcgcttcttcatgacgcaggcgataccagtcgcatgagtcatccggctggctttgatacggcagcggcgtggctttgcgattaccgacgaagaacagataaccgagcatttcgacttcgctacgctgttgaccatcgcccagcagcgatgccacgtttacccccagatgctgccccagcagatccagcattgccgcttctatcccggtaactacatgaatagtggtacgtaggtcaaatgtctgcaaaccgcgcccaccagcatcacgatcggcaaaagtattacgcaccagcgtcagaacgtttttgtattcacccagcgttttacctaccaccagcggaatcgcatcttccagcgttttacggattttctcgccgccgggaatttcccctacgccagtgtgaccagaattatctttgataatcacaatattacgcgtaaagaacggtgcgtgtgcaccactcagattcatcagcatactgtcatgacccgccaccgggataacctgcatttcagtaacaacaggcgtcgtaaattgagaactcatatttatgtcctttttcagaatcaatgacggccgaaaacgggacgtttacggtcaaaggtccagccggggatcaggtactgcatcggacctgcgtcgttacgcgcaccgccaggcagacgtttataggcctcatgtgccttttgtacctgttcccagtccagttccacgcccagaccgggcgcatcaggaacggcaatttttccgtttttaatctccagcggattttgggtcaggcgacaatcgccctcctgccaaatccagtgggtatcgatagcggtaggattacccggtgccgccgcgcccacatgggtaaacatcgccagagagatatcgaaatggttattagaatggcagccccaggtcagcccccagtcgtcgcaaagctgcgccacacggactgcaccggaaagcgtccagaagtgcggatcggcaagtggaatatctaccgcattgagcatcaccgcatgacccatttcgcgccagttggtggcgatcatgttagtcgcgacgggcaagccggtcgcccgtcgaaattccgccatcacttcacgtccggagaagccctgttctgcgccgcatggatcttcggcataggtaagaacatcattcagccctttgcataaagaaatggcttcatcaagcagccatgcaccgttgggatcaacggtaatccgcgcatccgggaagcgtttcttcaatgcacgaacagtgtcgatttcttgctcgccaggtaacacgccgcccttaagtttgaaatctttaaagccgtagcgatcctgtgaggcttccgccagacgcacaacggcttcgctgttcattgctttctgatgccgcaactgataccactcatggttgcccggcgtattttccacataaggaagatcggttttggtccgatcaccgatataaaacagataaccgaggacggtaatagcctcgcgttgcttgcctggccctaacagttcgcagaccggaacattcagcgccttacctagcaggtcaagcaaagcggcttccagcgccgccacggcgttaacgcgtaattcaaaggtccaggcacctttaccgaaggtatcaaaatcggcggcctgattacctttatgcacctgctggaccactttattcagtcgcgcaacttcctggcccagaaccatcggaatagcatcgacaagcgtctgataaatcacatctccgcccggcgcttcaccaatgccggtatgcccggcgttatcggtgagtaccacaatattgcgggtgaaatatgcgttatgtgccccaccaatattaagcaacatgctgtcatgcccggccaccggaatgactttcatatcagtaataacaggactggattgtgtcgccatcttattgccccgcaacaggtttcaactcgatacgcttgatatcgcccaccagcaccaggtagctcagtaccgcgattaaggcatgaacaccaacataaatcagcgccccattaaacgagccagtcgtgccaacgatataaccaattgcgattggcgtgacgatgccagaaatgttaccgaacatgttgaacaggccaccggaaagaccgctgatctcttttggcgcggtatctgccattactgcccaacccagcgccccgatgcccttaccgaagaaggccagcgccataaagccgatgatcatccactcaacgttgacgtagttgcagaacaccatcaccatcgacagcaacatgcccattacgatcggtgttttacgcgcaatgttcagcgatcccgtgcggcgcatcagccagtcggaaataatcccacccagcacaccgccgataaaaccgcaaaccgccggaacggaagccacaaagcccgctttcagaatcgacatcccgcgtgcctgcaccagataaaccgggaaccaggtaataaagaagtaagtcagggcgttgatacagtactgaccgatataaacgccgatcatcatccgtgaccctagcagctgtttgatctgcccccacttcacgctgaacggcactttaactttggtgttttgctgatccatattgatcagcgcaccacccgcggcgatgtactccagctctttcttatttacccccggatgttgatttggctcgtggatgactttcaaccagataaagctgatgacaatccccagaccgcccataaagaagaagacgtgtgaccagcccacttcatgcgtcagccagcccataatcggcgcgaagatcaccgttgcgaagtattgagcggagttaaaaatcgacaccgccgttcccctttcctgcgccggaaaccaggccgcaacaatgcgactgttgccggggaaagatggcgcttcagcaagcccgaccaggaagcgcagcgtaaacagggcaacgataatgccgaatccactaaagatatcgacgaagccttgcagcaaggtaaacatcgaccagataaagatcgaccagaagtagacgcgttttgaaccaaaacggtccagcaaccagccaccagggatctgcccgataacataagcccatgagaaagcagagaacacatagcccattcccacgggatcaaggccgatatctttggccatttccgaaccggcgatagagagcgtagcgcggtcgccgtagttgaaggatgtgacgataaacaacatcaccactatccagtaacgagcatttgtgcgtttttccacactgctcgcagcctgacttaaagaactcattgttgcactcctgaaaattcgcgttagccacgctcactctggactgcgacatcgccaggaaatcagaggtgacgtagggtgttttttgccgtttttataggtcgttcgccgaatacggcgcgtgtttatatctggcaatagcagtataaaaagcgcgccatagcggctcaccgtgcaacaacacaacattaatgcgttcaatgaggcccgattttggcattagccctggacggtggaatccacttcacggaaatgaaaacaagaacaagaaaggaagggttaaaacgaagaaataaagaagagtatgaaatggatcgcttgactccaggcaaacgccagtaaaaatccgcgctatgaagcagtttttactggcatttgcctgaaaagattcgattcagcaccgctaaaacgacatttaccgctcgctgaacatatcaggacaacagcgtgccccactgttcgacccacggatttgattccgtttccggttccgggttctcactggcgtcaatcaacagcatttcgccaacccgctgagcgctctgttcctgcaacaaggcatcgaactgtttgccgccattgcagaaattcacataactactgtcgccgagcgcaatcacgccataacgcagattcggctggaagcccagactatctttgattccctgaaagagtggcacaatgctatcaggaaggtcgccctgcccggtcgtggacgtaaccaccagaacatacttatcctgatagggcagccagtcgcttaattcaggatcttcaaataccgttgctttgtggccctgcgcggtcagaatcgcttccgcttcttcggccactaacagtgaattcccgtacatggtgccgacaaaaataccaatttccgccataccgttttctccctggattaggaacttatctctccatcctgacccgatggcgcactgaactcaaccctttcattttcaggaagcagaccgcgccagccaaattgtgataacgcctgcatccaggtgtcgtccaggcccgcgtgaatagtcagcggctcgccagtaaaaggatgcgtcaatgacaactgactggcatgtagcattaaccgctggaggccaaaatgctcagcaccgctgcgattctggcgtaaatcgccatgtttgctatcgccaataatcggatgacgcaaatgggcaagatgtcggcgaagctgatgtttgcgtccggttttcggctccagttccaccaggccgtagcgcgtggtcgggtaacgtccggtcgctaccggcatttctacggtcgccagaccgcgataatgcgtcactgctggctgcgggcctttatcttcgcgggcaaatttatcagcgattttgtccagttcttccaccagtggataatccagcaccgcttcttccatcaaccagccgcgcacaatcgcatggtaacgtttctggatttggtgctgttcaaactgttgtgccagcagccgtccggcctcgctggataatcccatcaacaacacaccagaagtgggtcggtccagacgatgagcagtaaaaacatgctggcctatctggtcacgcacggtttgcatgaccactactttctcgtcgcgatccagccagctgcggtgaaccagccagccggagggtttatttaccgcaaccagccattcatcctgatagagtatttccagcattagctcgcatcatccgcaaaaagagcatccagtttttccagctcagccagaataagcgcgcgttgcggatggtccgtcgccagcgccatttcataatagggtgcaacggcaaaagcgcccggtaacggctgtttgttatctaacaaatcgtgcattcgcgggatcagcacccactgcaaccactccagtggttccatggtgtccataaagaacggttgggtactattaaattgatgcggctggggttcatcgtttcgccagtgctgatgttcacgcagtaacgcttcaagcgcctgcaactggagacgaacgcggtcatgagtggtcataaagcaacctcaataagaaaaactgccgcgaaggatagcaggaataaaaaaagggagcactgtattcacagcgctcccggttcgtttcgcagcattccagctacttttgttgctccctgctcatccttgacaacttttcctctggccttgcggccaatcgttcatcctgaactattgcttcctgctcacaccaccccgatgtgatacttcatcctgaagtgtccctggccttcctgacccaccgaatcatcctgaccggttctcattctccatcctggaggtgtcctttaacgcgtcctgcgtcatcctcttcgcttcatccagaagcctttccctgaaacaccatcctggtgtgtcctgcagaagtgtcatcatcctgatgttcacttcgttgtctgactccctgtcgacgaagatagaatcgtctttttcgcgaagtcttacaaggcgcttacagacaatgccttaaggaaaatttcatatgaaagttaagaattaacaatcaacattttgattttaaatgaaaataacgattcttatctttttaagtattcgcttatttcctggcgatctcctacagagtctgtaagagatctctcacaaccagatggggtatttggattacagaagaggcttaagttgattaaggaattccgcaagatttgaggctaaatgcgtccgtttacgtgttcccagcgtctctttgcacacttcaccggagagattacacaccgagatgacctctaactcttcttccagcgtcgcgataaatagtgtgggcggcagttttagccttttctgagtcaccagatgaccaatcagattttcctgcacccgacggaagtcgtcttcactccaggtttgcagcaatgtcagtttgatatcgccaaactgcgcgtgcatatccccggcaaactgagtcgtataaaaggtatgaattgtgggttgtatcacaatatcaaaagcgcgttcaaccgcgtttacattttgttccccggtaaacggctggggttgccagtatacggcatcttcggtagttgaaataatgcacggtgaaggaacaccgtacagttcctcacttaacggccagcttttatgctcttcatgccacgcatcgcagtagcgtgcagtaaaatctttcagggcttgtgcggtcaaatcgtccactaatttctctcttcacttaaaccagatacacttgtcgtttagtttatctggtttatgacggtgaaacatgtcttcttatgcaaaccatcaggcacttgcgggcctgactcttggaaaatcaaccgattaccgggatacctatgacgccagcctactgcaaggcgttccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgctcagggtaagattagcgtggcgttatatcgtcttgatgaactggaaggccagccgataggtcattttaatggcacttgcattgatgaccaggatatcactatcgataactatgaattcactactgactatctggagaatgccacctgtggtgaaaaagtagtggaagagacgcttgtcagccacctgctgaaatcaaactgcctgatcacccatcaaccagattggggttcgctccaaattcagtatcgtggacgccaaattgacagagaaaaactgctgcgttacctggtctcattccgtcatcacaacgagttccacgaacagtgcgtggaacgcatctttaatgacctgttacgcttctgccagccagaaaaattgagcgtttacgcacgttatacccgtcgtggcggtctggacattaacccgtggcgcagtaatagcgattttgtcccatcgaccacaagactggttcggcaataaattttttctcaattttgcgtgctggattcacgcagaaggttgtgaaaggtcatcaggcagggctattgtaatcaaagggaatgacgatattcgtcccataaggagtttttcttgattacacatattagcccgcttggctccatggatatgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcttgcgccgtgaacgcggcgtaaagctggaactgattaatcccccggaagaggcttttgtcgatgggcgaattattcgcgctttgcaggccaacttgttcgcggtcctgcgtgacattctcttcgtttacgggcaaatccataacaccgttcgttttcccaacctgaatctcgacaactccgtccacatcactaacctggtcttttccatcttgcgtaacgctcgcgcgctgcatgtgggtgaagcgccaaatatggtggtctgctggggcggtcactcaattaacgaaaacgagtatttgtatgcccgtcgcgtcggaaaccagctgggcctgcgtgagctgaatatctgcaccggctgtggtccgggagcgatggaagcgccgatgaaaggtgctgcggtcggacacgcgcagcagcgttacaaagacagtcgttttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacggcagaagagttgctctatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgtgatacaggcgatgcctacagctttaactggtcaatgcgcattgcgccagatttgcaaatgccgtttgagccgtctcacgagaatatggctaatctgaagctttacccggatcaacctgttgaagtgctggctgccgacctgcgccgtgcgttctccggtattgtggcgggtaacgtaaaagaagtcggtattcgcgccattgaagagtttggtccttacaaaatcaacggcgataaagagattatgcgtcgtatggacgacctgctacagggttttgttgcccagcatcgtatgaagttgccaggctcagcctacatcccttgctacgaaatctgcacgtaatctccgctcccccggtgacgtttgttgccgggttttctcgtttttggtcacttactcatcaactcatttcatttgttatatgaatgtttcttaccaccctcacgcgacaaatatcatcacagttaatatgtcatacaatttatgttgcaacgcaaacgtttccctattttcataaaccgtattttatcgctatgaaaaagaaattatcgccatgattaactaaaagtattgattttttcagttcaacctacatatattgcgcgccccggaagaagtcagatgtcgtttaatgggcaaatattgcccttaaattctcttttacttttgatttacagagtaaagcgttgggataatctatcttccaagtagattattgtatttgagatcaagatcactgatagatacataacttgtgtgtatctttccgccctcaaattattacggcggtaaatgattaagccatcgccgatagacagatttcatttttacggtcaggcaccttcccgggctgaactggctaaaagctgaattatttgcattcctccaggagaaatagatggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattaccctgctctacttcttcgctatctacccgatcctgctggtttatagcgtggcaatcaccaataccgttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgctgcactggaaacgctgtctctggacactgcatctgcaaccggaaacggtctgtggatgaccctgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgtgtactgagcctgactccggcagacctggctgcggctaaagagcagaacatctcgattctgtcttacctggctaaccactttaacgcaccggttatcgcgtggatggctccgattatcgcgattatcgctatcaccaaatccttcctcggtcactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggtccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaagtcctttcgcgccgctttcgggcggcgcttcctccgttttaacgcgatgtatttcctatgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacactgatatcgccattattatgggcctggcgggtaacctgccggataccgtggatatcgattccatccccagttttattcaggatgtgaatactcatggtcgcctgatgctggcaaacggtcagcatgaagtggagttcccggttgatcagtgcatgaacttccacgccgacaacctttctctgcatgaaaacggtatgcgcattaccgcgctggcgggcgataaagtcgtttacagccagacttactactctattggcggtggctttatcgttgatgaagagcattttggccagcaggatagcgcaccggttgaagttccttatccgtacagttcagcagccgatctgcaaaaacattgtcaggaaaccgggctgtcactctctggcctgatgatgaaaaacgagctggcgctgcacagcaaagaagagctggaacagcacctggcgaacgtctgggaagtcatgcgcggcggtattgagcgcggtatttccaccgaaggcgtgttgcctggcaaactgcgcgttccacgccgtgctgcggcactacgccggatgctggtcagccaggataaaaccaccactgacccgatggcggttgttgactggatcaacatgtttgcactggcagtgaacgaagagaacgctgctggcggtcgcgtggtgactgcgccgactaacggtgcgtgcgggattatcccggcagttctggcgtactacgacaagtttatccgcgaagtgaacgctaactcactggctcgttacctgctggtagccagcgccattggttctctttataagatgaacgcgtcgatttctggtgctgaagtgggttgccagggtgaagttggcgtggcgtgctcaatggcggcggctggtctggcagaactattaggcgcaagcccggcgcaggtgtgcatcgcggcggaaatcgccatggagcacaacctcggtctgacgtgtgacccggtcgccggacaggtacaggtgccatgcatcgagcgtaacgccattgcggcagtaaaagcggtgaacgccgcacgtatggcgctgcgccgtaccagcgagccgcgcgtctgcctcgataaagttatcgaaaccatgtacgaaacaggtaaagatatgaacgccaagtaccgcgaaacctctcgcggcggcctggcaatgaagatcgttgcctgcgattaatcgctctccaaaggcctcgttttgcgaggcctcttcccgatttctcatccagccgtagcctgttccggcatcgaatgttacccttatcgcctgatctttaagggggttatcgtggctgttcatttgcttattgtcgatgcactgaatcttattcgtcgcattcatgccgttcaggggtcgccctgtgtcgaaacctgccagcatgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacgacgagatgcctgcattacgcgccgcctttgagcaacgcggcgtcccgtgctggtcaaccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactggggacttgcggggatcagcagttcaaaggtaccgggtgttgcgggaatcggaccaaaaagcgccacgcagctgctggtcgagtttcagagtctggaagggatatatgagaatctggatgcggttgccgaaaagtggcgcaaaaaattagaaacccataaagagatggcgtttctgtgccgcgatattgcccgcttacaaaccgatttgcatatcgacggcaatttacagcaattgcggttggtacggtaacggcgagccggatacgccgcaaacgtcgtatccggcattatcacatcagcgcatttaccaggcggtatggtaaagctctacaatatcctcaagcgttgcttcacgcgggttgccaccggtacaaacatcatccagtgccgcctgcgccagtgccggaatgtcttccttgcgtacaccaacatcacgcaaatgtggcggaataccgacatcacggttgagagcaaacaccgcttcaacagcggcattacgcgcctcttccaggctcataccttccactttcacgcccataacgcgcgcgatatcgcggtacttctcaccggtaaagtcagcgttataacgcatgacatgcggtaacaggatggcgttcgcaacaccgtgtggagtgttataaaacgcgcccagtggatgcgccataccatgcaccaaccctaacccaacattcgagaagcccatacccgcaacatactgcccgagcgccatttcttctccggcatccttatcaccagcaaccgatcctcgcagcgccccagcaatgatttcaatcgctttaatgtgcagtgcatcggttagcgcccacgcgccacgggtaatatacccctcaatagcatgagtgagcgcatcgacacccgtcgcagctttcagcgctggaggcataccatccatcatgtcagcgtcaataaacgccacctgcgggatatcatgcggatcaacgcaaacaaacttgcgccgtttctcttcgtcagtgatcacgtagttaatggtcacttctgccgcagtacctgctgtggtaggaattgccagaatcggtacactgggtttattggtcggggaaagcccttccaggctacgcacatcggcaaactccgggttgttgctgataatgccaatcgctttacaagtatcctgtggagaaccaccaccaatagcgatcaggtaatccgcgccgctattctggaatacaccgagcccttctttgacgacagtaattgttgggttgggcactacgccgtcgtaaatcgcccatgccagccctgcagcatccatcttatcggtcactttcgccaccacgccgcattgcaccagcgttttatcggtgacgatcagcgccttctgataaccacggcgtttcacctcatcggttaaagccccaacagcaccccgaccaaaccatgccgtttcgttcagaatcattctgttagccatcatccttctccttgttgctttacgaaattactcttcaattcgtaacccataggttttgaatttctccagcactacggcaatctcttcatcgctcagcactggcaccgggtccgtaatcgccagggtcgtcaggtaaagttgcgccagcacttcaacttcatgcgccagccataacgctttttccagattcacctcacaagcgataagcccatgatgttgtaacaaagttgccttacgatttttgagagccagcgcaacatgttcagaaagttcgcgtgttccaaaggtcgcataaggcgcgcaaggaatagaattaccgccagccgccgcaatcatgtagtgaatagcggggatcgatcggttaagaatggaaactgccgtgcaatgaacggcatgattgtgaacaaccgcgttggcatccggtctgctttgataggctgccatatggaaacgccattcgcttgaggggagctttccttcctcatgtttaccgttgccatcaataaagacaatatgcgactccgtcagtttttcatatggaatgcctgtaggcgtaatcagcatcccatcctgataacgtacactgacgttccccgctgtcccctggttcagtcccaggcgggtcatttccaggcaagtgtcaataatctgacgagcaagtttatttcgttccattagctacctctctctgattcaaaacagggcaataatgttgttcctttcacactattgaattagccgtttaattacccaccatcttcttcctgattaacaagaaagaaattcacaagcttatattttgtgacctggttcaactaatcacagtaaataactgcaagttctctttttataaccccattaaaaatgaccgctcttaaaaatatttatcaaaacggtcatttttctattcctccaagcccggaatgaccgttttcggcacaaacaattaatacggtcatctgatttgtgttttttatgatttattttctgaaacgggcatgaaatttcgattattaaagtgatggtagtcacataaagtcaccttctagctaataagtgtgaccgccgtcatattacagagcgttttttatttgaaaatgaatccatgagttcatttcagacaggcaaatattcactgatatgaagcccgaactcgctggttttgcacttttgaaaacataaccgattacgtgcttaagcttctgaacctaagaggatgctatgggaaacacatcaatacaaacgcagagttaccgtgcggtagataaagatgcagggcaaagcagaagttacattattccattcgcgctgctgtgctcactgttttttctttgggcggtagccaataaccttaacgacattttattacctcaattccagcaggcttttacgctgacaaatttccaggctggcctgatccaatcggccttttactttggttatttcattatcccaatccctgctgggatattgatgaaaaaactcagttataaagcagggattattaccgggttatttttatatgccttgggtgctgcattattctggcccgccgcagaaataatgaactacaccttgtttttagttggcctatttattattgcagccggattaggttgtctggaaactgccgcaaacccttttgttacggtattagggccggaaagtagtggtcacttccgcttaaatcttgcgcaaacatttaactcgtttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcggtattagcgcaattctgctatgtcggcgcacaaacggcctgctggagctatttgattcgctacgctgtagaagaaattccaggtatgactgcaggctttgccgctaactatttaaccggaaccatggtgtgcttctttattggtcgtttcaccggtacctggctcatcagtcgcttcgcaccacacaaagtcctggccgcctacgcattaatcgctatggcactgtgcctgatctcagccttcgctggcggtcatgtgggcttaatagccctgactttatgcagcgcctttatgtcgattcagtacccaacaatcttctcgctgggcattaagaatctcggccaggacaccaaatatggttcgtccttcatcgttatgaccattattggcggcggtattgtcactccggtcatgggttttgtcagtgacgcggcgggcaacatccccactgctgaactgatccccgcactctgcttcgcggtcatctttatctttgcccgtttccgttctcaaacggcaactaactgaacatattttccgaataaagtgaggaatctgtaatgaaaaaaatcagcttaccgaaaattggtatccgcccggttattgacggtcgtcgcatgggtgttcgtgagtcgcttgaagaacaaacaatgaatatggcgaaagctacggccgcactgctgaccgagaaactgcgccatgcctgcggagctgccgtcgagtgtgtcatttccgatacctgtatcgcgggtatggctgaagccgctgcttgcgaagaaaaattcagcagtcagaatgtaggcctcaccattacggtaacgccttgctggtgctatggcagtgaaaccatcgacatggatccaacccgcccgaaggccatttggggctttaacggcactgaacgccccggcgctgtttacctggcagcggctctggcagctcacagccagaaaggcatcccagcattctccatttacggtcatgacgttcaggatgccgatgacacatcgattcctgccgatgttgaagaaaaactgctgcgctttgcccgcgccggtttggccgtcgccagcatgaaaggtaaaagctatctgtcgctgggcggcgtttcgatgggtatcgccggttccattgttgatcacaacttctttgaatcctggctgggaatgaaagtccaggcggtggatatgaccgaactgcgtcgccgtatcgatcagaagatttacgacgaagccgaattggaaatggcactggcctgggctgataaaaacttccgctatggcgaagatgaaaataacaaacagtatcaacgtaatgccgagcaaagccgcgcagttctgcgcgaaagtttactgatggcgatgtgtatccgcgacatgatgcaaggcaacagcaaactggccgatattggtcgcgtggaagaatcacttggctacaacgccatcgctgcgggcttccaggggcaacgtcactggaccgatcaatatcccaatggtgacaccgccgaagcgatcctcaacagttcatttgactggaatggcgtgcgcgaaccctttgtcgtggcgaccgaaaacgacagtcttaacggcgtggcaatgctaatgggtcaccagctcaccggcaccgctcaggtatttgccgatgtgcgtacctactggtcaccagaagcaattgagcgtgtaacggggcataaactggatggactggcagaacacggcatcatccatttgatcaactccggttctgctgcgctggacggttcctgtaaacaacgcgacagcgaaggtaacccgacgatgaagccacactgggaaatctctcagcaagaggctgacgcttgcctcgccgctaccgaatggtgcccggcgatccacgaatacttccgtggcggcggttactcttcccgcttccttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccatggggttctgaccatcggccacgttggcgcagactttatcactctcgcctccatgctgcgtatcccggtatgtatgcacaacgttgaagagaccaaagtgtatcgtccttctgcctgggctgcgcacggcatggatattgaaggccaggattaccgcgcttgccagaactacggtccgttgtacaagcgttaatacattactccctgatgtgatgcccggtcgctccggctaccgggcctgaacaagcaagagtggttagccggataagcaatgttatccggctatattgcaggagcgattatgaaacaagaagttatcctggtactcgactgtggcgcgaccaatgtcagggccatcgcggttaatcggcagggcaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgaatgccacatccgcggtatcgccgtcaccacctttggtgtggatggcgctctggtagataagcaaggcaatctgctctatccgattattagctggaaatgtccgcgaacagcagcggttatggacaatattgaacggttaatctccgcacagcggttgcaggctatttctggcgtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatatcacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgctgaacaaaatgaacccgtgctctcttccggtacatgggaaattttaatggttcgcagcgcccaggttgatacttcgctgttaagtcagtacgccggttccacctgcgaactggatagccaggcagggttgtataacccaggtatgcaatggctggcatccggcgtgctggaatgggtgagaaaactgttctggacggctgaaacaccctggcaaatgttgattgaagaagctcgtctgatcgcgcctggcgcggatggcgtaaaaatgcagtgtgatttattgtcgtgtcagaacgctggctggcaaggagtgacgcttaataccacgcgggggcatttctatcgcgcggcgctggaagggttaactgcgcaattacagcgcaatctacagatgctggaaaaaatcgggcactttaaggcctctgaattattgttagtcggtggaggaagtcgcaacacattgtggaatcagattaaagccaatatgcttgatattccggtaaaagttctcgacgacgccgaaacgaccgtcgcaggagctgcgctgttcggttggtatggcgtaggggaatttaacagcccggaagaagcccgcgcacagattcattatcagtaccgttatttctacccgcaaactgaacctgaatttatagaggaagtgtgaaatgctgaaaacaatttcgccgttaatttctcccgaactattgaaagtgctggcagagatgggacatggagatgaaattattttttccgatgctcactttcccgcccattcgatgggaccgcaggtgatccgcgctgatggcctgttggtgagcgacttgctccaggcgattatcccgttatttgaactggacagttatgcaccgccgctggtgatgatggcggcggtagaaggtgacactctcgatcctgaagtagaacgacgttaccgtaatgcgctttcactacaagccccgtgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaatctcataccggtacgcccgcatgacgcgggcggttatcgaatgatggggtgaaaaatatgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatggacgcgctaaatatatccaccgtcaaaatcaagacagtggcgatccctttcacatcaggctgaaaagccattatgcgcataaagcagatatcgcgcgcgaggcgctcgcgtggattgaagaagggatggtgatagccttagacgccagttcaacttgctggtatctggcacgccagttgcctgacatcaacattcaggtcttcaccaatagccatccgatttgccatgaactcggtaaacgcgaacgcattcaactgatcagttccggcggcacacttgagcgcaaatatggctgttacgtcaatccctcgctgatttcccaacttaaatcgctggaaatcgatctgtttattttttcttgtgaagggatcgatagcagcggcgcactgtgggactccaatgcgatcaacgctgattacaaatcgatgctattaaaacgtgccgcgcaatcgttgttattgattgataaaagtaaatttaatcgttcaggggaagcccgcatcgggcatctggatgaggtaacgcacattatttctgatgagcgccaggttgcaacttctttggtaacagcctgacggaaagggtagcaggccggagacgacgccccggccttgcctgttatcgctcgtcgcgacgaccacccaccgcagcccagatgcggcggacgtgcaccgtcacttcttcgcgatcgtgatacaactgccgcgcctgaatctgagcatttatgccatgttcatcaagctgtgcctgaatatacgccagattgtgtgacacttcttcgtagcgttttttcatcggcagtttgaggttgaaaatggtttcacggcaccagccattaaccagccactgcgccatcaatgccgcaactttcgccggtttttcaaccatatcgcataccatccaggagatattgctgcgcgtcggacggaatttgaaaccgtcttcccgcagccacgtcacctgtccggtatccatcagactttgcgccatcgggccgttgtcgacggaataaacccacatgttgcgcttcaccagttggtaggtccagccgccagggcaagcgcctaaatccaccgcccacatcccgttcgccaggcgttcatcccactcatccgcaggaataaacacatgaaatgcctcttccagtttgagcgtggaacgactcggcgcatctgccggaaatttcaggcgcggaatgcccatatagaacggcgaattattgttgctgtatgagtaaccggtatagcagcagcctggtgcaataaagaatacatgcacaaccggacgcttcggcgtttcatagttcgccagcaccccggcatcgcgcaaggcagcgcgtagcggaacagtaaatttacggcagaatttcagtaactctttgctttcgttggtatcggcaacttcaacacgcagttcaccgcccttctctactacgccctgtaacatgccgacaatgggggtaatacgatcttctggcggcaaatgctgcaggagttcccccaccacaaaccactggcgggcaaaaattaatgaactgaacggcagctcacggattaacttatcgccatcatcaggttgataacattcataaatgacataacccgcattctctttcacgcgggcaaaaccgaaaatttcccgctggccggctttatcggtaatttctgcggcgcactctttttcaaagcccggacggcacagcaatacaaccttattcatgacttacgcccttgcgctttaaacggatagcaccaactaacattaacgcccagcccgcgaggaagctcacgccgccaaccggagtgacaaacgcccacaaacgcagatgggacagcgccaggcaataaaggctgccgctgaacaacaccgtgcctaacgcgaggaaaacgctactccagtaaaaccagatactgatgcgacgctgcattgccaccgccagacctaagatcgccagcgtatgaaacgcctggtattcgaggccggtctggatccagcccatctcaacggcccccatggttttacttaacacatgcgcgccaaaagcgcccagagccacaaaaatgaagccgctaatggcggcgaaaatcagcataaaacggctggtcatggtcgtaccctacgtaaattattgttcataacgaaagcggaatttttcttgttcagcagcggctttcgccaggatccattggcgaaaggcggctattttacccagttctgcctgactgtcatgacaaaccagataaaaagcatttttactgaccagaacatcattaaacgggcaaacaagacgtccggcctcgatttcagattgcgccatcacgttatttgccagcgccactccctgcccgtggatagccgcttgcagcaccatggcgctatggctaaaaattggcccttgctgaacgttgatatgatttaaccccaactgtcgggtatatgtctgccagtcacggcgcgaagcatcatgtaataacgtatgtttagccagatcttccggtgtcttcaagggtttttcgccagtcagcagtagcggcgaacacaccggcaataaatattcggcgtacagtttttccacccgtagccccggccagttgccccgaccataaaatatcgccacatcaacatcatccgccagcttatcttcctgacgatcaaccgcctggattcgaacgtcaattcccggataagctgaattaaagctggaaagtcgcggaaccaaccaatgaatggcgaaactggggagtaaactgaccgtcaacgcccccttggcgctacgggcctggagtttacgcgtcgcttcggttaattgcgaaaatatctctttgatatcgaggaaatagctttgcccttcctcggtcagcaggagtgaacgattacggcggcggaacagttttagccccaaaaaatcctcaagagacttgatttgatgacttactgcggcttgggtcacaaaaagctcttctgctgcgcgagtgaaacttaaatggcgtgctgcggcatcaaaaactcgtaaggcatttagcggtggtaatcgtttagacatggctattaaactttgatgttaaatgaatttaacaattagatcacactatgtaacctattagtttttttaatctgagccattataaattgtccgttgagcttctaccagcaaatacctatagtggcggcacttcctgagccggaacgaaaagttttatcggaatgcgtgttctggtgaacttttggcttacggttgtgatgttgtgttgttgtgtttgcaattggtctgcgattcagaccatggtagcaaagctaccttttttcacttcctgtacatttaccctgtctgtccatagtgattaatgtagcaccgcctaattgcggtgcttttttttaccttgcgatcgcgaattactgatccagttcgaccatctctttcacgtcagtacggttgatctgctgtttgttgccattagcgtctttatacgaaatcataccggtatcgttatcagtctgtggtttgccgtcagagacgatggtacgtccgtcattggtgtgcatcacatagttcgaaccggaacaggcgctcagggcaaaagtcagcatacaggcagaaataattgcggcagtctttttcatcatcttctccttaaagcgattaataaatcttaatagtattgattaacaggctaaaattaacgcctaacactattcagcatatgttacttacgcggcttcgccaggatatccagataattctgatggttagcactctccttgtatcaaagtgaattttgcgtcacgatcggtgcatcaagccgaggagtaccatgaacgtttttaatcccgcgcagtttcgcgcccagtttcccgcactacaggatgcgggcgtctatctcgacagcgccgcgaccgcgcttaaacctgaagccgtggttgaagccacccaacagttttacagtctgagcgccggaaacgtccatcgcagccagtttgccgaagcccaacgcctgaccgcgcgttatgaagctgcacgagagaaagtggcgcaattactgaatgcaccggatgataaaactatcgtctggacgcgcggcaccactgaatccatcaacatggtggcacaatgctatgcgcgtccgcgtctgcaaccgggcgatgagattattgtcagcgtggcagaacaccacgccaacctcgtcccctggctgatggtcgcccaacaaactggagccaaagtggtgaaattgccgcttaatgcgcagcgactgccggatgtcgatttgttgccagaactgattactccccgtagtcggattctggcgttgggtcagatgtcgaacgttactggcggttgcccggatctggcgcgagcgattacctttgctcattcagccgggatggtggtgatggttgatggtgctcagggggcagtgcatttccccgcggatgttcagcaactggatattgatttctatgctttttcaggtcacaaactgtatggcccgacaggtatcggcgtgctgtatggtaaatcagaactgctggaggcgatgtcgccctggctgggcggcggcaaaatggttcacgaagtgagttttgacggcttcacgactcaatctgcgccgtggaaactggaagctggaacgccaaatgtcgctggtgtcataggattaagcgcggcgctggaatggctggcagattacgatatcaaccaggccgaaagctggagccgtagcttagcaacgctggcggaagatgcgctggcgaaacgtcccggctttcgttcattccgctgccaggattccagcctgctggcctttgattttgctggcgttcatcatagcgatatggtgacgctgctggcggagtacggtattgccctgcgggccgggcagcattgcgctcagccgctactggcagaattaggcgtaaccggcacactgcgcgcctcttttgcgccatataatacaaagagtgatgtggatgcgctggtgaatgccgttgaccgcgcgctggaattattggtggattaatgacaaacccgcaattcgccggacatccgttcggcacaaccgtaaccgcagaaacgttacgcaataccttcgcaccgttgacgcaatgggaagataaatatcgccagttgatcatgctggggaaacagcttccggcattgccagacgagttaaaagcgcaggctaaagagattgccggatgcgaaaaccgcgtctggctgggatatacagtggctgaaaacggcaaaatgcatttctttggcgacagcgaagggcgcattgtgcgcggcctgctggcggtgttgttgactgccgttgaggggaaaaccgccgccgagttgcaggcacagtcaccactggcattgtttgatgagctgggattacgtgcgcagcttagcgcctcacgcagccaggggttaaatgcgttaagcgaggcgattatcgctgcgacgaagcaggtttaagcacagaaccgggtcggataagacgttcgcgtctcatccgacctgattgtttaaccctgacgcgccgctttcgccatcatcttcttcagcgcatgagaaaccgcaacaaacccaaaggtggcggtcaccatcgttgccgcgccaaatccagatgcacaatccatccgcttcggcccttctgccgtggctttcatcgcacacaccgtaccgtctgactgcgggtacaccagcgcttcagtagaaaacacgcaatccacgccgagcttacctttactgtttttcactacgccaaaatcgcttttcaggcgctcgcgcaacttcgccgccagcgggtcctgaatcgttttcgccagatcggtaacctgaatctgcgtcggatcaatctgcccacccgcgccaccggttgtgaccagtgggattttattgcgccgacaataagcaatcagcgccgctttgggccgtacactatcaatggcatcaatcacgtacgaataacccacgctcatatactgcgctacgttatccggcgtcacgaaatcatccaccaccgttacacggcactccgggttaatctggcgaatacgctccgccataacttccgcttttgccagcccaacgttatcgcgcagggcatgaatttgccgattggtattggtgacgcacacatcatccatatcgataagcgtgattgcgccaatccccgtgcgcgccagcgcttccgccgcccaggaaccgacaccaccgataccaaccacacaaatatgcgcgtcagcaaacagttgcaacgctttttcaccatacagacgcgctgtgccaccaaaacgctgacgccatgcatcactaattaccacagacatagcacctcagaattaaaaagggcgaggttatccctcaccctaaacgcataaatgcctgatgcgctacgcttatcaggcctacataactcctgcaatattttggatttgcatgatttgtaggccggataaggcgttcacgccgcatccggcatgaacaacgcgcacttagtcaataatcaggatgtgaggttacccctcaccctgtcatatccgtaaaaacggcatacagaatatcacatcagccgctaaagacgttacctgcgcccggggcggttttcagcacccagacacgtccatagtggttgtaccaacctgcgcggtgtccggcttccggcccgatcccttgatagatatcgaagtgttggcctttgattgcaccaccgacatccagcgccaccatcagacgcagttcgtactgaccattaaatttgccgttattatccagcaacggcacttctgccagcaaggtagtacctggcggaataatggaacgatcagaggcaactgacgcgcgaccaaccagcggcaccgcacttgcccctttcaccggagcaaaagattgcggtttaaagaagacgaaagacgggttctgttccagcagctcgcgaacctcggcttcactgtgtgtttcgccccagtgacgaatcgcctgcatcgacatatcttcttttttcacttcgccacggtcgatcagcaccttaccaatgctgcgataggcatgaccgtttttccctgcatagctgaaaaagttaagcggactgccatcaccaaagtcgatatacccactaccctgcacatccataatgaagttatccatcagggagttactgtaagcgagaatatatttatcactcaatgcccccgcgtagatctccgcacgagacggcagacgaccacgttttggcggcatacggtaaataggatactggaactcgccctggcgggtatggcgcgcctgaattaccggcgtgtaataaccggtaaactgcacgttaccatagttgtcggcaccttccatctgccaggcatcaatgccgaactggcgcatattgcgggtatcaccgcctgcgcgcagccactcttgcaccgcgttataaacattactctggttgccatacagacgcggtgacgaattacggatatggttaatttgctcggcaaaatcaccggcgttaatcggcgcgccaacggcatctggctggttcaccagagagaaaggctgggtaaatttcccgtctttatattgctgtccgcgatcggttggtttggaagagcaggcggcaagcattgccacaaccgtgcccataagaaggtactttacccaacgtcctttcattgttctcttcttcaggttaaaaaataaggcgcaacgaagataacaaaccgccgcgtttaatgaaatgagcagcctctccctgacgcaaattttgcacaaaaaataggctttagtgatttgtttttgttcaaaatcatgccaaatccgtgatcggggtaaaaaaaaggttgcatgaaaacgcgagcggagtatagtgcgcatccacggacgcggggtggagcagcctggtagctcgtcgggctcataacccgaaggtcgtcggttcaaatccggcccccgcaaccaattaaaatttgatgaagtaaagcagtacggtgacgcggggtggagcagcctggtagctcgtcgggctcataacccgaaggtcgtcggttcaaatccggcccccgcaaccaatcaaatttgatgaagtaaaagcagtacggtgacgcggggtggagcagcctggtagctcgtcgggctcataacccgaaggtcgtcggttcaaatccggcccccgcaaccaattattgaacaccctaacgggtgtttttttgtttctggtctcccataaaaaagcgccattcagcgcctttttatcatccccttctcgccagcgtcgccccatcggcaaaatacgctttaatccccgcaagaatagactccgcaacttcctgctggaaagtcgccgttttcagtttacgctcttcctcaacgttactgataaacgccgtttcgaccagaatggagggaatatctggtgcctttagtacggcaaacccggcctgttcaacttgatttttatgcagcttgttgattttaccgagcttattcagtaccgctttaccaaacttcaggctgtcggcaatggtcagcgactgtaccatatcgaacatggtgtggtcgacatagcggtcaccgcttttgctcacgccaccaatcaagtccgaggcgttctgggtttgtgccagatattttgccgcagtactggttgcacctttggttgagagcgcaaacacagaggaaccgctcggctgacgactggtaaaggcgtcggcatggatagagacaaacaggtcagcacgctgtttctgggcttttgctacgcgcacttgcaatggaatgaagatgtcttcattgcgcgtcatgtacaccttcatattgccctctttctcgatcagagagcgcaaacggcgagctatttgcaataccacatctttttcgcgcgttttgtatttccccaccgcaccggagtcttcgccaccgtggccagggtcaagcataatgacaatcggacgatcgcgccctgctttacccggttgtggaccactttgcgctggcggcacctgcttttcgaggtcgcctttgttgtaatcctccagcagcgccagcagcgggtcctgcatatcctgtgcattggccggatagaggtccatcaccagacgctctttaaacccggcgaccggcgcaagggcaaacagctgcggttttacgttttgctttaattcaaaaaccatccgtacggtttgcgggtcaaattgcccgacgcgcgccgacttgatgaacgggtcgtctgcacgaatttgtgccgccatccccttgagtaccgagttcaggtttacatcttcgatatccaccaccacgcgttcagggttactcaacgcgaactgcttatatttcagctgacgatttgattccaccgtcacgcgggtgtagctggacgcaggccagacgcgcaccgccacgacctggctgaccgcagccagactgacctgacttacgctcaatagccacatggcacccgcgccttgcagtaaacgacgacggctgattgcagtgttggatcctgacatgcctctcccgagcaaaagaaatctaagctgtgtaacaagtaaacgactaatttgaccggaaactttagcgaaagacgcataatctgtcatctaataaacggtaaacattctttttatattcacggcattactgataaaaaagtcgctctcgcataaaatttacacttgcaccctgcgaaaaaacagaataaaaatacactaatttcgaataatcatgcaaagaggtgtgccgtggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaagcgatgaaaatcgtcggatgcgacatgcgtaacactcgtacgtcgcatccggcaattacgtttattcccgtgaactaaacaacgccgccagaccactgcgccgctcagtacgagtggcgattgccgcacttaatatgcgctcatcggcatacagcgacagacggcgacgcgcgcgggtcaccgcggtataaaccagctctcgcgttactaccggcgtgcgttggctcggcaaaatcaacgccgcatggtcgaactccgatccctgcgatttatgtaccgtcatcgcccacgtagtttcgtgctctggcaagcgactcggttgcacagacttaatattgccgtccggcatcgcaaaccagacgcgcgtcccctgcccgcgatccagcgcaataccgatatcgccattaaacaacccaagcgcgctgtcattacgggcaatcatcaccggtcgaccttcgtaccaacgagagtgcggatgacgatgaattttgcgcttctgttgcataaactgctcaattcgctcattcagtccagccacgccaaacggcccttcccgcagggcgcacaaaagctggtactcattgaacgcctgaatgattaaatccggctcggcacgcgcttgcagcagatccagataacgtccgtaacccgcaagagcttcctcaagcatcgcaatataatcttcgccgctctgtaaaagccgtttttcgatatcagtaaaatcctgctgaaaaacggttttcactgccgttttatcaccacggttgatcgccgcagctaactgaccaatgccagaatcgctgccgaaacgatagcttttttgcagcaggcagagactgtcgcgcaaagatgccgcttctgtgccggttcctgccggaacgtgagtccccgtcaggcggcttagctgcctggcacgctcggcggtaaagcccgcgttggcataagcgcagatatcgcccagcacagccccagcctcaaccgaggccagttgatcacgatcgccgagaaagatcactcgcgcatgatcgggcaaggcgtcgatcagtctcgacatcataggcagatcgatcattgacgcttcatctaccaccagcacatcaagatgcagcgggttaccggcatgatgacgtaaacgctggctacccggctgcgcgcccagcaatcggtgcaaagtgctggcatcttccggaatgcgtttcttttgttcatcggtcagcggtaactgtcgcaaagccttgccgagagattcggttaagcgcgcggcagctttacccgttggtgcagccagacggatacggcagcgttcgccgtcggccatttgaattaacgctgccagcaacttcgctacggtggtcgttttaccggtgccagggccgccggaaatcaccgagatccgccgcgtcagcgccactgccgccgcaactttttgccagttaatttcatcgcttactggaaaaagtttgtccagggtttgcgccagtagagcttcatcaacctcaatggcatgattcacttcgttgaaaaagcgtgccactgtgcgctcgttacaccacatgcgattcaaataaagacgatcgccacagaggatcatcggcgtgggttcatctcccctgctgaccgcttgagaagccagcaagcattcttcccaattttgtagctcaccgatttcactgacacaggtcgccaacagcggatgcgacgcctcgttattttccagtcgtgaaagcggcaaacaaacgtgtccctctccggcatcatgacttaacagtgccgccgcgagggtgacggcaggatgttcatctcccgccacggtcagggcaaattgcacatccagcgggcgtagctgtttgtgctccacagcttccagtaattgcttttgcaatttcattacgcctcctccagggtcataccggcaaacatctcatccatcagggcaatcaacccggcgttgggtcgggttgtgtaaatcccctgttgcggatgttctttatcaacgccacgcaggaacagataaataacgccgccaaagtggtgctcatagtcgtaatcagcaatgcgatggcgcagataacgatgcagcgccagggtataaagctgatattgcagatcatagcggtgtgcctgcattgccgctgccatagcctgttgggtgtaagccgaactgtcttcacccaaccagttggatttatagtcgagcaggtaataacgcccttcgtggcggaacaccaggtcgataaagccttttaacatgccacgtacctgcatgaactccagcggcgggcagcctgcggatagcgggtcaaactggcggattaacgtatcaagctgactggcgataagcggttcactaatcggcagataaaactccatctccacctgtttattgcgggcggaaagttgactcaggcttacgccggtttcattgagaggtgcctggaggacagccgtgatccactcggtcaataccggttcccactgcgattcaaagccgccgagttccagtttttcccgcacccagttcgggtcaaccggctgggtaaaatccaggtcttcaaacaaactgtgcaagaacgtccccggtgacgcaccgcgcggaaactgatgtggtgttaacgtcggttcttcaacgacgctggcaacgcctgcagcatcgacatccagccgaggcatcaaatcctgggcgataccgtgaccacgctgttgcaaaccagagtagctggtgacgcgccagttatcgccgggcaatcgttgtaacgtcttcgcattcagctctgctgtagaaacatcattaacctgccagggttggttatcaccagtttgtgccgtttgccaggcaatatcatcatcgcataacgcttcaatacaggtgcgaagccctgccgcatcttgcggttcccctttttgcagcaaacgcccgagcgcactttggtggacgtcggtgtcaccttttttatcgccacgacggcgcaccagcggtgcaacgccgagactgcaatgccaaaccgaacgtgtcagcgccacgtaaagcaaacgcagatcttccgccagacgttcggcctccgcgaggtcgacgctttctggcgcagcattaagatccagaactgcctcaaacgagtggcgatcgtgataaaacgcctgctcctggacgcggaaattggtgataaacggcagccagaccaatggatattccagccctttcgatttgtggatcgtgacaatctgcaccagatgtttatcactttcgagacgcatttgttggctggaggcattactgtctggctcgaggatatgttgcgataaccagcgtaccagcgcatgttcactttccagctgcgttccggcttcttgtagcagttcgctgatatgcaagatatcggtaagacgccgctcaccgcctgccgttgccagcaagttttcagcaatgttacgcgccgacatcagcgcccgcagcatcggcataacgccacgtttgcgccagatttgccgataaccatcgaactcttcgactaccacatcccacgcatgttcgtcattgttcagcgtttcgatatccagcgcgttcagccccatcattgacgttgccagcgcactacgcagggtgttctcacgttcgggcgtcatcaccgcctgcaacaaccaaagcatttcctgcgcttccagagtttcaaaaacactgtcgcggttcgaaaggtaaacggaagggatttccagcaacgttaaggcatcgcgcacctgggcggcctcctggcggctgcgcaccagcacactgatgtccgaagcacgcaccggacgcgcgtcgtcgccgttcatcagcaacgcttcgccccgctgtccggcttgtagccagtcgcggatttgcgcagcacatacctgcgccatggtactttgataatcgccaacgccgcagctttcgccttccatcagccacattttcatcgcaggctgtgtttcacctttaaatacaaaacgtaacgcctgatttttcccggctgatttcactggaataaacggtatttcgcgaaacatgaacgcgtcatcagtctggctgaaaagcttattcacgctgttcaccattcctggtgcggaacgccagttggtgtctaaagtgtagtgggcgtgaacttcgctacgcgccttcatataagtgaagatatccgcaccccggaatgcatatatggcctgcttcgggtcgccaattagcaacaatgcggtttccggctgatggtgccagatacggcgaaaaattcggtactgctgggggtcggtatcctgaaattcatcgatcattgccaccgggaatcgcgtacggatcgccgctgccaacacctcaccgctttcgctacgcagcgcggaatcgagccgacttaacatgtcatcaaaacccaattcgccacggcggcgtttttcacgcgctactgtttcgcggatctcagccaatgcgcgggtgatcaccagatcgcggatcgacaatggttctgcaagcagttgatcgatcgcctcaaacagtggatgtcgcggggtttcccccccggccttcgtgcgatcttctaagaaacgctgggagaatttttccagcgactccggcaactgataactgtttgtctcttcttctgcccaggcgctgatcttgtcgatccatttagcctgattgctacggttaaacttgcgtcgatcaataccagaagattcgatcagcgcatccagttcacccactgcgtcgcgccactgctgttttaccgtatcaatacgcgccacaatttgcgcgtgacgggaagccagcgtttcatcatcgggcggcggtgctttgataaccggcgcttcgccttgcagataacgattaatatcgcgcagcaacgcctgcggccctttccaggtttcaaagacgacctgggctatttcacgcggcagcgggtagcagtggcgacgccagaaatcggcgcaggcctggtagcgtagcagagactcatcttcaatcagctgctgctcaaacagcatgccggattcaaaggcattcaggttgagcatgcgctggcaaaagccgtgaatagtaaagactgccgcttcatccatctgccgttcggctaacaacaaccactgcgcggcttgcgctttatcgtcgatctcttccagcaggcgttcgtacagtggattgtcggtggtttcacgcagacaggcgatgcgcaactcgtggatattgctacggatacgaccgcgcaattctgccgtggcagcctcggtaaaggtgaccaccagcagttcttcaacggtcagcgggcggggaaaggcggcggaaccgcctagtccaagtaacaggcgcaaatagagcgccgcaatcgtaaaggttttgcctgtgccggcagaggcttcaatcaggcgctcaccctgtaagggcaagcgcaaaggatctagtgtctcggcgacatcactcattcttttcactcatcaggggcattgtttgctgcaacgcgctgacgttctcccacactttccagccttcagggtgtacatattcggctttcccgttctggctgccggaaatctgcgacagaatagccatgccttgcggctcgaccaccgcctgatggaagaaatcagcaagtttttgcggcgtcagcagttttatctgggccacgattttatcacgcgaatcgaagcgcatattgccgcgatcgaaatctttacttaacttcgatgcttcttcgccgagcgtttgcggtgcctgcagcatctgggtaattaccgcctgctggatttgcgcaaactcatctggcttcatcgctcgcaattttgcctctgcggttgggaaaaacgccttgtaacgctcccacaagaatgaaggctgtttatcattgctttgcaaaaggaagcccatgccccactgacgccccacgctcattggaaacgcaaacacggcatagcccaattgttcttcggtacgcaactgattgtagaaccacggctgtacgatctgccccaacagagagctataggctgagctggtgtattcatcgtagccagtcggtacaaataccgctgccagtgcggagtcggtgctgttaccggctttttcaaagatgacggattgttttttatcgaccactacatctttgtttcgacaccactctgaaccatcagcgcccaactgtttttgcacatcgcgtgccagcgttgttgcctgggcctcggtcatgttgccgataaccataaactctggtcgagcccctgattttaaggcgtcgcgataggccagcacctctttcaacgtaatggagggcaaaattttacgccgttcatctcgcgagaagtacggcacttgcgagagcatctgcgcgggcataatcgcctgctcaaacgctttacccttttctgcggaatccatcatctggttataccaggacttcgcctgctcaagctgatcttccgtagcggtatagctaaagtacccctcgagcaatgcctggaacagctgcggcagacgctgggtgtaaccattagcattaaccataaggccgttgttagcgttggtggaaaaacttatgccaccaaccgacgcctggttgcttaactgatcaagcgccagccctgcgagataatcattgagcgcaaacatcacctgattgcgggcgctgtccatggctttcggattacgcaaaatcaggctgacatcagctttgggctcgctggcaaaataacggcttggcgcatacaccacgcgcagattcgactcatcaacaatcagctctggatggtcgtatttcttctctgacttaatcagcgagaaatcatcaggaatataagggttaagctctggcaaagagagcgcaatgtcggcggcttttttctgccagtcggcgaaagtttgtgcgctgattttatcgacctgatacggcgcatcgacaaagtaagccgttttgttgtgcggctctttcgggctgatataccagatacgcgcattctgcggcgtcatcatcgccagacgttcctttactgctttagcatcgtaccgatcggcaatattgactgcatccagcgtatgctcaacaggaacgcgaatcatggtatctgccagccattcgacgtaatccatatcacgggtgatcgacggataacggaagtcgatatccagcacattcgccagttcatcgaagtattgtttatcaatgcctttttcacgtaacagattgagatagctaaaaattgccgccacaacctgatcgcgattagccaggcctttatcggttaaagacgcagagatcgctaatacgccgctgttgccgttgacgataggatcggagttggcgctaatgccctcaactaatccctgcttttgcagccagtcagaaagtgtacctgggctgcgattgccaatcagataggtaatcaattcatcggttttactacggaacttcgctgagttgttatcgatgcgaaactcaacgcgcaacactttacgcggcagcgcagggacgtaatgaatgataatgcccttttgcgcgtcggtgactaccggcacggtgatttccggttttttgctctctttgttcggcacgcgaccaaaggtgtccgccgccatttttgccaactccggcagcggtttattactgtaaataaccgccttcatcaaattggcggaatagtacttctcgtggaaatctttcagcgcctgctgcaccggattaccaggtttgtcgcttaaagtttcgaggttaccaccagaaaactttgaaccggggtgtgccgggttaatggtttctgcgctgacctgtgccatgcgcatcccgtcacgcgtacgcgccatggttaattcagcgttcaccgcattacgctcacgttcggcatatttcttgtcgagcaaaggttcagcaatagcatcggccaggcggtctaccgcaccaggcaaggcgtcgttctcaacttccagatagaaagccgtgcgatacggcgcagtgctggcattgtgactaccgccgtgcattttgagatattcggccagactgtcagcctgcgggtactttttcgaccccatcagactcatatgttcaaggtaatgtgccagcccctggtacgcctcgggatcttccagcgacccaacgggcaccaccagcgccgagagcgatttaactgcctgcggatcagaaaccagcaagaccaccataccgttatccagacgtatagcctgatactggcggttatctttatcacttttacggatggtttcctgaatcggctgccatcccgtttctgcctgacttaagggtgcccaaagggcaactaacaacaataatgctttgaaccaggtgctgcggggcattcacggacctcataatcaacttaattttctgtccagattcaacacgttaacgcaaatcatctgccagaatttaatcttgtgctgcacgagtcagcctatgtttatataaccatcagtccgtgactggtgcgcatcataaagtaagcggatagattgcgcaatttttatacagcactcatgactgattaaagcgaaacagcggtaacaggaaacgttgcgactgttcaacgatggcctccattgtctctggtgttaattgccgccagagcctttgataccagatatcatcaccttcgccacgcaccatcatgttgccttcgtaagcctgaaggaatttcgtacgggctttttgcaacgtggaatcgtcatccagcatggcatcgttttgcgcgtcataacaggtttttagccacgcgccgccactttcaggtaacaccagcaatggcgcggacattccttcacgatacccctcaatcagttgtgagaggtaatgcaaagcctgttcggctgcaagcggcggaaaacgccactcgccgtctttgcgtagaaaaaggcgactttcaccattaccaccgctggcacagtagacaaggtgttccagccaaagttgcattccctgggccacacttaataaagagggacgccagcgcaacaggccatccggctgcacctgcggcaaccagccagttatctgcacaccgttgcaggcgagatcaatttccatactctgccccggctggcgacaggcaatgactctgtcggcaagctgctgcatctcctggcactgtgtttcccagaaaatttcaccaaaagcgccatacggtaaatcccctgccgctcggaagcggcggaacaagcgttcggcatcatcctgctcaaccagtgcattcaataactgctgattgatttgataacggctaagtccttccagaataaatggctcggtgtcggggatttcgctgtcttcagtacggaagttcacctgcaaacgcatctggaaaaatgcccgcaccggatgtgcccagaatcgttgtagcgtttccagcggcacggtttccggtaaggtaaacggcagcggctgaacaaattcagaatgtgctttaccagcctggctggccgcaggtagccattcacgagcatagctttgtcgttcgcctggctggtagttttgtggatcaaacggcatccgggtatggaggcaagtaagatgcgcttttacccttgcctcgctttcatcacagttgagcgcttcatcgcccggtagataatgactttgcccgatgtagtcgatcagttcctgcaccagtaccgacgggaaacgctcactgttatcctgaatggaacgaccgatatagctgatatagagtttttgctgcgcggaaattaacgcttccaggaacagatagcggtcgtcatcgcgacggctacggtcgccacgcttcggtttctggctcatcaggtcaaagcccaatggcgcaagctgacgtggataaacgccgtcgttcattcccagcaggcaaaccactttgaacggaattgaacgcattggcatcagagtacaaatgttaaccggtccggcgagaaaacgctggctgatacgttcttgatccagacgctgtgccagttcatcacgcaatagtgacagcggcaccgcgtcgccatactgcgcacctaaaccttcggcgataatcgcctgccattgttgttcgatcagcgtcatcgccgcttcggtttccgcatccggcaggaagaaggcgttgagcatatcgcgacaaaccggcaaccactcttccagcggacgctcctgtgccagcccgcgacgccagatgtttagctgcattagcagtgaagccagatgccccaccagttctgcaattaagccgctcgattcatcataaggtagaaccgattgccactcgccctgcgcgctctccatcgcgtagcccaacaacatacgcgtcaggccaaatcgccaggtgtgttgtccggtggcggggagttccagctcgcgaacgttgtcgtcatctatgccccaacgaatgccggattcgttgacccactggcgtaaataacgcagcccttcttcggtgatgtcaaaccgcgccgccagcaccggcacatccagcaacgccagcacatcctctgacacaaaacgactgtcaggcagtgataacaggctgataaacgcttccagtaccggatgtgactgccgcgcacgacggtcggaaatggcgtaaggtaggtaacgatccgcaggtgcgctaccaaacacagcctgaataaacggactgtagctgtcgatatcagccaccatcacgatgatgtcgcgcggagtaagtgtcgggtcttcctccagcatcgccagcaggcgatcgtgtaaaacttcaacttcacgctgcgggctatggcaaacgtggaaggtgatactgctatccagtggatcaagcgggcgtttgttatcgctacgggaaaactcttcgatgttcacaccagcaacggcgcggttttccagttccagaatgtcagactgaatgttatgcagcaggttatctggcgtgacatcgacaaaggcgtccagctcctggctgctctccaggtcagaaaggagataaatgtagtcgcgcccaagcttaccccatgaagccagcagcgggttgccgacatcctgttcaccatcgctgttaaagagctgcccggcattttcgctatcacgaaatagcggcaattcgcgatcttcaaaactgtgtcgacgctgacgggtcagcagtttcgccagataagcaggatctttaatatcgccccagtaataacggcaggggttggtaaacaggagatggatttcaatatgtttacccagcgcctgtagcgcctggagataaacaggcggtaacgcggaaataccgcatataaagacgcgcgaaggtaaccccggcgggcaggtcgtcgcggactccagcgtttcgataaagcgctgatagagattggcgcggtgccagcgcggttgcccgagttgatgggtatattccaccagcgccttccacaacggggcttgccaggcctgtgcttctcccagcccttcaaccaaatgtcctgtttcccactgtgccagccagtccggacgatagaccagatactggtcaaacaggtccgccgcttttgaggaaagctggaacagttttcgcttgtcgctatcgtcagtcagataatgccgcaacagggtaaagtcttcgcgctccagcaattgcggcagcagagtcatcagtttccagctcatgctctgtttgttaaaggcgctctctttggggatttccggtaacacccggacgaacatatcccagataaagctcgctggcagcggaaaatcaatgtttgccgcaataccaaacttttgcgacagggtcatttgcagccactgtgccataccggtactttgcaccagaatcatctctggttcgaaaggatcgtccagccgttcgcgttcgacaataaactccatcaacgcttccagcacgtccagacgattggaatggtagacccttaacatagcggctcctgactactgacgattcgggcaatgcaggcgggtcatctcgccttctctgcccccgggtgaaactagcgtaacgctgatgctgacacatcccgcctgcgatgtctgcattcggttgacctgccagttggcaggtggcgaaatcgcgcgcagttgcgtttgctgccagccatgccgccagagctgttggtactggtttctgctggcaagactgttcattaatgttcgctggaaacccgataacgcagtgacaatcatcaccatcaacaccatcgccaacattacctccggcaggctaaagccttgttgattcttcagggaagctgacataacgccctctctttcagcggacaaaaatcgctccagccgcgtggcgaaaaaacaatgtttccatcaatgacttcgcctgttcgccacaacgaaacgccttcataaccggcaatcaataaggcttcattatctgccagtaaacgcaaacaaacctgggcatcggtttcagcgtactgcgagcactgaactgctggctgcgtctgccagcagtgcatttttccccacgccagcgccgactgaacgatggcctggcggcgcaatgactgactttccatgctcacgcgagaggcaaaactgcgatcctgttggctcattccttgtaatagcaaactacccaaaaccagcagcatcaggaccagagccagtgacgaaacacccttttcgcggttcacaggttgaatcctgtcacgctatagctggcattcaccacggtttgcggttcagacttactggcagcacgcatattaaccgtcaacaccggcgagaagccgctgacatcctgacgtacgacctgaaaagtgtcgataatgatggcatccggattagtgactttatcccagcccttaccttcacaggatgtcgcaccgcgtagcgtttccagcacatgctccttcagacgaaatccaatctggtcggactcttttaccggttcgcgatcccagataccgttactgttcgcatcccactgcacaatgacacagtcaccctgtccgacaatttccagcccttcgccggtacagatgccatgacaataacccgccctctggagatgcttcgcgacggtaaatacccgcagccagatttcatcttccagcgccagcttacgggtgctcgttaaactttcacgctgtaacgcaggcagaaagcgtgccgcccccagcaacaatacgctactgatcgccatagcaatcaacacttccagcagagaaaaaccttgctcttttacaggcatccttctgtttctccttgctgacaaagccggagtcttccccacggcgaaaccaccagccaccactcgcccgttgagtttttgaagcgaatatgcccggcccatgcggtattgcgcaggccaaagaaagcaagcgaaggtgtcaggtcgctcatttcgacttcgggccagcgtggcacaaagaccaatggtgaactgccatgacaggtattggccccagcagcggaactcacaaggcaccataacgtcccctccctgataacgctgatactgtggtcgcggttatgccagttggcatcttcacgtaaatagagcaaatagtcccgcgcctggctggcggtttgccatagccgttgcgactgctgccagtattgccagccatagagtccacttgcgcttagcatgaccaaaatcagcatcgcgaccagcgtttcaatcagcgtataaccacgttgtgttttcatgccggcagtatggagcgaggagaaaaaaagacgagggccagtttctatttcttcggcgcatcttccggactatttacgccgttgcaggacgttgcaaaatttcgggaaggcgtctcgaagaatttaacggagggtaaaaaaaccgacgcacactggcgtcggctctggcaggatgtttcgtaattagatagccaccggcgctttaatgcccggatgcggatcgtagccttcaatctcaaagtcttcgaaacggtagtcgaagatggattcgggtttacgtttgataatcaacttcggcagcggacgcggttcgcggcttaattgcagatgagtttgatccatatggttgctgtacagatgcgtgtcgccaccggtccagacaaaatcacccacttccagatcgcactgctgcgccatcatatgcaccaataacgcgtagctggcaatgttgaacggcaggccgaggaagacgtcacaggagcgctgataaagctggcaagagagtttgccgtctgccacatagaactggaagaatgcatggcacggtgccagcgccattttatccagttcgcctacgttccacgctgaaacaataatgcggcgcgaatccgggtcgtttttcagctggttcagtaccgtagtgatctggtcaatatgacgaccatctggcgttggccaggcgcgccactgtttaccatacactggcccgaggtcgccgttttcatcggcccattcgtcccagatggtgacattgttttcgtgtagataagcaatgttagtgtcgccctgcagaaaccacagcagttcatggatgatggaacgcaggtggcaacgtttagttgtcaccagcgggaatccatcttgcaggttaaaacgcatctgatgaccaaaaatggaaagcgttccggttccggtacggtcgtttttctgtgtgccttcgtcgagcactttttgcatcagttctaaatactgtttcatggttcctcaggaaacgtgttgctgtgggctgcgacgatatgcccagaccatcatgatcacacccgcgacaatcatcgggatggaaagaatttgccccatgctgatgtactgcacccaggcaccggtaaactgcgcgtcgggctggcggaaaaactcaacaatgatgcgaaacgcgccgtaaccaatcaggaacaaacctgagacagctcccattgggcgtggtttacgaatatacaggttgaggataataaacagcaccacaccttccagcagcagctcgtaaagctgtgatgggtggcgcggcagcacaccgtaagtgtcgaaaatggattgccactgcgggttggtttgcagcagcaaaatatcttctgtacgggagccagggaacagcatggcaaacgggaagttcgggtcaacgcggccccacaattcaccgttaataaagttgcccagacgcccggcaccaagaccaaacggaatgagtggtgcgataaaatcagagacctggaagaaggaacgtttagtacggcgggcgaagataatcatcaccacgataacgccaatcaggccgccgtggaaagacatgccgccgtcccagacacggaacagatacagcggatcggccataaactgcgggaaattgtagaacagaacataaccaatacgtcccccgaggaagacgccgaggaagcccgcatagagtaagttttcaacttcatttttggtccagccgctgcccggacgattcgcccgtcgtgttgccagccacattgcaaaaatgaaacccaccagatacatcaggccgtaccagtgaagcgccacgggtcctattgagaaaatgaccggatcaaactccggaaaatgcagatagctactggtcatctgtcaccacaagttcttgttatttcgctgaaagagaacagcgattgaaatgcgcgccgcaggtttcaggcgctccaaaggtgcgaataatagcacaaggggacctggctggttgccggataccgttaaaagatatgtatatgatccgcgctataaccctccgcgaatcagcccgcccatgccgcgacgctccataaaggctgcaacctgatggcgaacttcggtcgccagttgcgcttccagactacgctgcgcaagattttctgcttcggcataatcaatgcgccgcagcaggtattttgcccgcgctacagaacgtccgttcatagacagatggcgatacccaagcccaatgaggattgccacgcacatgggatcgcccgccatttcaccgcacaaacggagatcgattccatgtatttccgcttcccgggcgatcatcgccagagctcgtaacattgcaggatgaagactgtcataaatgttcgccacccgggtattgttgcgatcaacggccagaatgtattgagtcagatcgttggtgccaacagagatgaaatcgacccgctttgccagatgcggcagcataaataccattgacggcacttccagcatgatgccgatacgtggtttgggaatttcgtaaccgatcatctcctcgacttcacgtccggcacgttcaatcaggcggcgtgcttcatcaacttcatcgaggcttgtgaccatcggcaacagaatattcaggttgcccgtagcggcattagcacgcagcatcgcccgcacctggatcaagaagatctccggctgatcgagcgtaatgcgaatcccacgccaacccaggcatggattctcttcgctgatcggcatgtaaggcagctgcttatctgctccgacatccagcgtacgcaaggtgacgggtttatcattgaacatttgcagcatcccctgatactgcgccacctgttcttcttccgacgggaaaccactttgcagcatgaatgggatttcagtgcgataaagaccgatgccatcaatacggctgcccagtttttcttcatgttccgggcttaaaccagcattgagcatgacttttatacgctcaccgctttttaactgcgcgggtaaattgacgtcatcttccgccagacggctaagctcaatctcttcactaattagccgctgatattcttgcagcagtaccggctccggatcgaccagcaattcaccgcgatagccatcaacgatcagcgtcctacgatgcagcaccgaaggctgaatatccgcgcccatcacggtagggatccccagcgcacgtaccatgatcgcagcatgggagttggctgcgccatctcgcacgacaacaccgactaagcgatcctggggcagctcagcaagcgttgtcgctgacagttcatctgccaccagaatgaaacgttccggccaggcgttcggcccttgattagcgtcatcaagatgaaacagcaatcgctgacccagcgcacgtaaatcgccagcccgctctttgagatagttatcacttagcgcggcaaactgttcggcaaatttttcaatgaccgtttttaccgcccactctgccaccgagcctttatcaacctcggcaaacaattcgcgacgcagccgggtgtccgaaagcaggtgcgagtaaagatcgaaaatagccgccgtttctttttgtgcaccggcggcaaagcgtttgctgtagcggcgaaactcgtttgccgcttcttccagcgccccggtcagtcgttcgcgttccagagccggatccagcgttgatgcctgatacacctgttccattaaaggtaacgtggcatcctgccagccttcggcaatcgccacaccaggtgctgccggtaatgcgcggattcgcgtctggcgatattgcccaaacaaggcagtcaactgcgactgagaaagaatagctgccatctgggtggcaagcgtcaccaggaaggattcttcactttcgtcatactggcgcaactctcgttgctgtaccaccagtacaccaagcaactggcgacgttgaataattggtacgcctaaaaacgcgcggaaacgttcttcttttacggaggggatgtatttgaagctggggtgcttttgcgcatctgcaaggtttatcggttccgccagcctgccaaccaggccgacgatcccttcatcaaacgcgagcgttacagtgcgaccgcgtggttttttcagcccccgggtcgccatcaggtagtaacaacgtcgatcatgatcggccaggtagaccgaacagacctcggtatccatcgcaagacagatgtcggtaaccagaatatttaacgcctcattcaggcgtggtgcgctggctaccttttcgactatttcgcgcaggcgagtgagcataattggcgtgacttaacctcttttacgtcgataagcagatgcgttttgtggttttggcgtattttcctgcagtgacatcaccacactcgcgaactctttcattaccctacggtagacatcacgtttaaatgacaccacctgtctgaccggataccagtaacttacccatcgccagccgtcaaactctggtgtactgctggtttgcatattgatttctgcatcgccgctcaccagctgcaagagaaaccatttttgtttttggccgatacaaaccggcttcgtgtcccaacgcaccaaacgtttcggtaatttgtagcgcaaccagttacgcgttgaagcaaggattcgaacgtctttgcggcttaatcctacttcttcaaacaattcacggtacatcgcctgctctgcggattctccggggttgattccgccttgcggaaattgccaggagtgctgaccaaatcgccgggcccacattacctgcccctggcgattacaaatcacgatacctacgtttgggcggtagccatcgtcatcaatcaccggactacctcaaaataaagctttatatacgaatgattgtttcatactccaggaagacggtaaaccactctctgcagggcattacacactaataacaattgaataactcacagttatgtgcagagttataaacagaggaaggggtggatagccgtttttattcaccttttctgtggatagagttgtgaagaactacggaattactacgggaaaacccggagcattctgaataagcccgatatagacattttaaaatattcattatcagtcaatgcattacatgtaattttagtaatgaaaaagagtaattcgtgacccaggtcacacctctcatttacgggttggcgaaagatcaaccaatgccgtatttatccacagaatgtgccactaagttaagcactgaaccactaaaaactggagtttcgtcgcacgtcaaggctgtaaatggaaacagtagtggaggtttttcacagttatcccagctttctgtggataacatggtgtaagatcctgtttattttcagtgaccagatttggaaaacccgttgcagtgttgcgcaactcgattaccggcaacctaaaaagcaatataaatcagagaattgaacaacgcatgtggaaaaagttacactgcgaatattcggcacataattgctgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggagatctggctaggtgccagcgcagggagtaaacctgagcaagattttgctgctctgggcgtggaacttaaaactatccctgtggatagtcttggtcgtccgctggaaacaacattcgtttgtgttgccccgttaacgggcaatagcggggtgacctgggaaaccagccacgtgcgccacaaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagccatcgctttgacctgccgctttccgggcatataattaccgcttcatttttttggcagggctttttagatgttatttgcatggataaccgatcctaacgcctggcttgcgctcggtacgctgacgctgctggagatcgttcttgggatcgacaatattattttcctttctctggtggtggcaaagcttcccacagcacaacgtgctcatgcgcgccgtctggggttggcgggagccatggttatgcgtctggcgctgctggcatcaatcgcctgggttacgcgcctgacaaatccgctttttacaatattcagtcaggaaatttctgcccgtgatttgattctgcttctgggtggcttgttccttatctggaaagccagcaaggaaatccacgaatccattgaaggtgaagaagaagggctgaaaacacgcgtttcatcattcctcggcgctatcgtgcagattatgctgctggatattatctttagcctcgactcggtgattacggctgtgggtctgtcagatcacctgtttattatgatggcagccgtggtgattgccgtaggcgtgatgatgttcgccgcgcgctcgattggtgattttgtcgaacgccatccttcggtaaaaatgctggcgctctctttcctgattctggtgggctttaccctgattctggaaagtttcgacatccacgtaccgaaaggttacatctacttcgcgatgttcttctctattgcggttgaaagcctcaacttgattcgcaacaaaaagaatccgctctgatactccgtacgctctcctgcgggagggcgtactcactccttttaccctcacagtttaagattttcctgctttcaagatatataacgtcggtttataaacagactattatcataggtaggccaaatgaggataaccggatgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaacaaataaggtcagcatccggctggccttaagatttttctctttcccttttcccttccctctgccatttttatattccttatgtcgtgattataaaaaggaaacggctatgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaacgcaagggttaaccgaaacctacgtcggcaactggctggcgaaacatggcagccgcgaaaagttaattatcgcctccaaagtgagcggaccgtcgcgcaataatgacaagggcatccgcccggatcaggcgctggatcggaagaatatccgcgaagcgctgcatgacagcctcaagcgcctacagactgattacctcgatctttatcaggtgcactggccgcagcgcccgaccaactgcttcggcaaactcggttatagctggacggattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccttacagtctgttaaaccgcagttttgaagtaggtctggcagaagtcagccagtatgaaggggtcgaactgctggcctattcgtgcctgggtttcggcacgctgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcgtttgtacgccgtcaaccgtttgttgccagcactctgctgggcgcaaccacgatggatcagctgaaaactaacatcgaaagtttgcatctggagttaagcgaagacgtattagctgaaattgaagcggtgcatcaggtttatacttatccggcaccataagattaacgccggttaaaaccggcgttaaatattaatgacggcgctgccagatccacagcgccgttattgccagcgcaaacagcgcaccgaagccaatgccaatgggcacgaccgggatgcctatcattaccgccagcgagtaaatgcccagcatcaacaacatggcgctgttttcgccaaggttttgtactgcaatcgcattccccgccccgacgctttttttaccccgctcctgtagcaacgcattgagcggaacgacaaaaaagccccccatcacgccaatcagcatcaacaaggcataggctggcagcagctcgtgttgcagggaaaaaatcagtaccaccacgccaatcaaaatcccggctggcatacagcgtgacacggtttccagcgtaactaacttcgctgccgcacctgcgccaaccacgataccaatcgctaccatcgcgttgagataggtgggcgtagcgttatcggtaatgcccagcgccaccggtacccacagcaccaacaggaaacgcagcgtgacacccgctccccagaataaactggtgcccaccagcgaaaaacgcgtttcaccattgcgccatagcgaggtgcaggcattcaggaaactgcgggtcatgttgatgagattccaggactgccccggacgcgccgccgccagtttgggaatgtagatattggcaacgaccgcaccaccgtaggccagtgcgcatgcggccagggcgacgaggacatgccagtcagccagcacaccaccggctacggaaccgagcaaaatcgccgctatggtagaagcttccattaaaccgttagctttcactaacttactacccgtggttaattcgccgagaataccgtatttcgccggtgaataggctgcagcaccaacacccaccagcgtatagccgagaaacggattgataccaaagcagatactggctgcgcccagcagcttcaggccgttggcaaacatcatcacccggcctttggcgaagctatccgccacctgcccgacaaacggcgcaaaaagaatgtaagcacctacaaacaccatttgcaggatgggctggctccactccggatagaactgcgctttcagtaacgccagagtggcaaacagtagggcattatcgccaaacgcagagagaaactgcgccacgataaccgctttcatccccttcgaccacaacgaagtgttagtgtgcactgactcactcatcgtgttgttccgcttcgtctacccagcttttcaacgtgacaaagtcaggtttgccgctgccaagtaatggcatctgtttcagatagcgaatatcgcgcggtacagcaagctccggcacgccgtgctcgcgggcatactgttgcaacttatcgcgcgtcagttcgttatctgtggtgaaaagcaccagtgcctcgcctttgctggcatcgctcttaatcgcagtggcatggactttatctggcgaaacaccaagtgccagttgttccaccatttccagcgacaccatttcgcctgcaattttggcaaagcgttttgcgcggccctgaatctgcacaaagccctgctcgtcaaaacgcacaatatcgccagtgtcataccagccgcgctccatttcgccgcgaacattctcggcggtgggcacttccagtacacctggcttctccacccgcagatagccgttcattatgttcggccctttcagttgcaggcgtccgccctcttcgataccagggaccgacaacaggcgcgcatccattcctggtagaatacgccctaccgtaccgggtttcgccgccatcggtacgttgatagaaacgacaggcgcgcattcggtcacgccgtagccttcaaggatgcgcaggccaaatttatcctgccaaagctgtttggtactttcttgtaatttttctgcgcctgccaccacatagcgtagacgatagaagtcatacgggttggcgaaacgcgcgtagtgaccgaggaaagtcgaggtgccgaacaacacggtgcaactgcggtcatacaccaactccggcacaatgcggtaatgcagcgggcttggataaaggaacacttctgcacctgtaagcagtggcgtaaacaggcctaccgtcagcccaaaggagtgaaacagcggtaacgccgacataaagcgatcgttggtggtgaagtcggcaatcgttttaatctgctcgacattcgccagaatgcttttatggctatggacgacgcctttcggatggccttcagaaccggaggtaaaaaggatcagcgcctcttcttccggctgctgtttaacctgtgccagacgcggcatcagcaaatgagcgaagatccatactttgtcggcagtggtgacatctgcttttaaatcttccagatagacccagcgcacctgagtaagttgctccggcagatgccagagtttgcctttatcgagaaactggcgggaagtgaagatggttttgatttcagccgccgtaatagcactggtcagcccttttaccccggcagtgtagttcatcattgcgggcatgcggcgacgggcgatggccccaaaaatcactgccgcactgatgcctgcattgggcagcattaagccgatgcgttcgccttcaacactgtatttttcaaggatgcgtccaacaaacagcgttttcgtaagcaatttgcgataggagtctggggtaaagttgacgtcttcgacacatttcttcccggctccgaagcggtacattgcactcagtaaagattcgtacagcgtttcacgcgggcgcaccgccattcgcgcttccatcattatttgatgcagcatttcgccagcgattttgcgacggtcacgggcacgcggcgcatccggcatcgccacctgcgttggtggcaaaatatgcagagtaatttgcgggaacaagcgacgtttaaccagacctttcaggcggctgaagtgcgtaagttccgccccttcaatacgcacaggaataaccgttgcaccagacttcgccgcgacaaaacccgcgccatcgtagattttcatcagcgagcctgtcgtggtgatgcgtccttcagggaaaatcaccactggtcggccctgttccaccagacgtaccagatgtttaatagccataggttgcgtcgggtcgagaggaacaaagtcgataaatgatttcagccaacgcatataccactgttggcttattgaggtgtaaacggcaaacactggacgcacaggtaaaaacagtccaagcaaaatgccatcaataaaagagacgtgattaggcgtaattagaacgcgctcgcccttcagtgcctgggtgtcacccgtaacgcgaacgcgatacaaaacacggcacaaatttcgaaaaaagctaaaaagcattccaactccctttgctctgattcagtaaaagcgaatggagggagattacacgagataaagaacgcgagcgacagtaaattaggtgcgaaaaaaaacctgcgcatccgcgcaggttggtgcaagagacagggtacgaagagcgtaccgaataatctcaccaatcaatacctctgggatcttgattgtggtctgcacgacgactcttcgccagcgagaaaacgcaaaggaatgaagggaaatgcaacgaggtgtgtaaattgtcggttactgttacagattgatgaccggcaaaaaaaacctgcgcatctgcgcaggctggtgtaattcatgtgctcaacccgaagttgacttcacctatcaatacctctgggatcaccactttagcaacctgaagccaaacgccaccagcggtcaatcgcaacagcgtttcgcaaagtgtaaccaaaggtttgcaatctctttttttgtcttacttatttgcgtttggctcacattcccacgatgaaaacacgccaccccttgaaccaacgggcgttttccgtaacactgaaagaatgtaagcgtttacccactaaggtattttcatggcgaccataaaggatgtagcccgactggcaggcgtttcagtcgccaccgtttcccgcgtcattaataattcacccaaagccagcgaagcttcccggctggctgtgcatagtgcaatggagtctcttagctatcacccgaacgccaacgcccgtgcgctggcgcagcagaccactgaaacggtcggtctggtcgttggtgatgtttccgatccgtttttcggtgcaatggtgaaagcggtcgaacaggtggcttatcacaccggtaattttttattgattggcaacggttaccacaacgaacaaaaagagcgtcaggccattgagcaactgatccgccatcgctgtgctgcgttggtcgtccatgccaaaatgatcccggatgctgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattgcggccaatgaccggctggtgacatttggcgaaccagacgaaagcggcggcgaacaggcaatgaccgagcttttgggacgaggaagaaatttcactgcggtagcctgttataacgattcaatggcggcgggtgcgatgggcgttctcaatgataatggtattgatgtaccgggtgagatttcgttaattggctttgatgatgtgctggtgtcacgctatgtgcgtccgcgcctgaccaccgtgcgttacccaatcgtgacgatggcgacccaggctgccgaactggctttggcgctggcggataatcgccctctcccggaaatcactaatgtctttagtccgacgctggtacgtcgtcattcagtgtcaactccgtcgctggaggcaagtcatcatgcaaccagcgactaaccgcagttaaagcaattccagcgccagtaattcttcgatggtctggcgacggcgaatcaaccgcgcctgaccattatcaaacagaacttctggtaacagcggacggctattgtagttggatgacattgatgcgccatatgcccctgtatcatgcagtaccagataatcacctgccttcacttccggcaaggcgcgggtttcaacatttcccccttcctgctgggtaaagacatcgcccgattcacataacggtccggcgacgacggtttccaccgttggcgcgtgttccagagaacgaccatcagctgccagggcactgatatggtggtaactaccgtacattgccgggcgcatcagatcgttgaacccggcatcaaccagcacaaagtggcggctccccatttgtttgacgctccgcacctgagtaattaatacgccagactgcgctaccaggaagcgacccggttcaatttccagtttcacagggtggcccaaatggcgggcgatttgctcacgcgcggcattccacagaccataataatgttcggtatcaaccgcctcttcaccctgttgataaggaacagaaagcccaccgcccgcagaaatagcctgtaaatcctgaccgaattcgatgacctgacgcaccatagcaccacacacctgttccagatgggcataatcaacgccagaaccaatgtgcatgtgaatgccgaccagctgcagatgatgacgttgtatcacgtccagtgcggcgggcagatcggtgtaccagataccgtgcttgctgttttcgccaccggtattggttttttggctatgtccgtgaccaaaccccggattaacgcgcagccatacccgatgccctggcgaaacctggcccagttggtcgagcatatcaacagaacccgcattcaccggaatttgcaattcactgacgcgttcaagcgtcgcctgatcgataacatctgccgtaaaaacaatatcatcggggtgcgtttgcggattgtaacccgccgccaacgcacgctctatttcgcctaacgagacggaatccactttcacgccctgctcacgcattaagcgcaaaatatgaatattggaacaggctttctgtgcaaagcgcaccacatcaaactgtttcagcgctgcaatctgccgacgaataatttgcgcatcgtagacccacaccgggcagccaaattcagcgggcaaacgcagcagattttcggcggtgagatcggtatcggtgctgaacagtgaatgtggcataacaaactccagataagtgcttttttatgattacgccacatcataaaaagaataaaaaatatcgatttatgtcgagtctatgcaaaaatgatatggattaccggattgcgagagagcgctaatggccgccgttaacttacgtcatattgaaatttttcatgcggtaatgaccgccggaagcctgactgaggcggcacacctgctacacacctcacagccaaccgtcagccgcgaacttgcgcgctttgagaaggtgatcgggctgaaattgtttgagcgcgtacgtgggcgattacatcctaccgtgcaaggactgcgtctgtttgaagaagtgcaacgatcctggtacggactggatcgcattgtcagcgccgcagaaagtctgcgcgagtttcgccagggagaactgtctattgcctgcctgccggtcttttcgcaatcttttttaccgcagctcctgcaaccctttctggcacgttatcccgatgtcagcttaaatatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggtcatccgctggcggtaaaaaaggtattaacgccggatgattttcagggtgagaactacatcagcctttcccgtactgacagctatcgccagttgctggatcagctatttactgaacatcaggttaaacgacgcatgatcgtagaaacccacagcgccgcgtcagtctgcgcaatggtacgggcgggggtaggtatttcggtggttaacccgctcaccgcactagattatgcggcaagcggtttagtggtgcggcggttcagtattgcggttccgttcaccgtcagcctgatccgccccctgcaccgcccgtcatcagcgctggttcaggcgtttagtgggcatttacaagcggggttaccgaaactggtcacttctcttgacgctattttgtcgtcagctacgacagcataaaagcgacagcatcctcggcatggatcgccgcggtatcaaacacaggcaaaacactgcgctcttctggcaccagtaaaccaatttctgtgcagccaaaaatgacgccctgtgcgccctgttctgcaaggcgagcaatcacttgcgcacaataagcgcgtgacgcttcggtaaattgccccagacacagttcttcaaaaataatctgattaattttcgcccgttcatccgcttcaggaataagacaattgatggaaaattgttccgtcagccgcccgcgataaaaatcctgttccatggtgtaacgcgtacccagcagcgccacacgagtcattccggccccggtaattgcacgtccggtggcatccgcaatgtgtaagaaaggcagagtgcaacgtgactcaatggcatccgccactttatgcatcgtattggtacatagcacaataccttctgcgcccgcccgctgtaagccaagcgccgcctcagccagaatgtccccggttttatcccattccccgcgacgctggcactcttctatttcatgaaaatcgacgctatgtagcagcacttgcgcagagtgaagcccaccaagccgctgtttaatgccttcatttatcaaacgatagtaaggaatggtggattcccagctcattcctcccagcaaaccaattgttttcattcctctctcctgatgtgtgttaccgcaacaaggctgaataaggaacgagacaaacgcctcaacggccaagtgcccaatctctattaacgaaaaaagggccggatgtacagcacatccggcccgtgaaatcagacgccgatatttctcaacttctcgcctgccatcagtttgcgttcgatatgttccagcgtgacatttttggtttccggaatgagccagaaagtaatgcccacaaacgcaatgttcagcgcagtgtagagccagaacgtaccggcagcgccaatgctatcaagcagtgtcaggaaggtcgcgccgataatcatattcgacacccagttcgtggtggtcgaacaggtaataccgaaatcgcggcatttcagcggctgaatttcagagcacaggatccacaccactggcgcggcgctcatcgcataaccggcaatacacatcatcgtcatgccaacagagagccaggacaagccactggaagccgtaccgttatcaaactgcatcaggcaatagcccagcaccagagtgcctaacgccatcacgctgaaaccaattttcagagccggtttacgccctgctttatctaccgtaaacaccgcaataaaggtggcgaacataaaggtcagccctacgaccagagtcgcaatcatctgttgttctgtggtcgtaaagcccgccattttgaagatacgcggcgcgtagtacatgatgatgttcataccggtaaactgctgcatcgcctgcaacaacataccgagaaacacagcacgacggacgttacggttgatcttaaacagtgcccaaccgccctgttttaacttcaggctttcacgaatttcgttgagttcttctcgcgctttttccgacgtatcgcgcagcatacgcaatacttcttccgcctcaatatgacgccccttttccgccagccagcgcgggctatttggcaggaagactaccagaataatcagcagaactgctggtaaagcaagaacccccaacattgcgcgccagttaccgctataactgaacgctgtatcggataaaaacgccagcacgatgccgagtgtgaccatcaactggtacatactgatcatcttaccgcgaacgttttcacttgccatttcagaaagatacagaggagcggtgtaagacgcgatcccgacagcaatgcccagcaccacacgagcggcgattaacatctctacgctggtcgcaaaagcggaccctatagaaccgagtacaaacaggatggcccccgccatcaggctgtatttacgccccaggcggaacgacagccaaccattaaacagcgcaccaattgctgcaccgagcatcatgctactaaccacccattcctgcaaacgactggtcagcacaaagtgatcggtaatgaacggcaacgctccggcgattacgccgatatcaagaccaaataacaatcctgcgaccgcagcagctaccgaaacaaacatattcatacgccgcgtatcccgcaaagaacgtggcgttaaagcagattccgtattgatagtaaccattttttcctgccagcagagagtaagacatagtgaaaaaatacgtgaacaactcacgcaggtgtcaggtcggaaacagcataaatatggattaaattgctgcgacatgtcgttatgtgatggatattccaattttcaaattaagttgaattattgagattattattaaccacctaattttacagcagataaaattcataaagttcattaattgataattaatatggattatttcataaccatgatatggattatgatgatctacaggtataaaaaaccctgccatgcggcagggtcataaaagtaagaagaatgaattaacgcgccagccaaccgccatccacggcaatggtataaccattcacataatctgaagcgctggaggcaaggaacactatcggccccatcaggtcactcggcagtccccaacgaccagctggaatgcggtcgagaatttccgcgctacgttgttcatctgcccgtagttgttgagtattgttggtcgccatgtaacccggggctatcgcattaacattaatgttgtgtttagcccattcgttcgccatcaatcgcgtcacacccatcacgccgctttttgatgcggtataagaaggcacacggatcccgccctggaaggagagcattgacgcgatattgataatcttgccgccattgccttgcgcgataaagtgtttcgccgctgcctgagacatgaagaatacgctcttgatattcaggttcatgacatcgtcccagtccttttcgctgaactcgagagcatcttcgcggcgaatcaatccggcgttattcaccaggatatcaatatgaccaaactccgctaccgcgcgatccagcagtgctggaataccatcaatctttcgcagatcggcggtcaggcttaaaaaacgacgccccagcgctgtgacctgctcgatggtttcagtcggttcaacgatgttaatgccaacaatgtcacagcccgcttgcgccagccccaacgccatcccctgacccagtccagtatcacaaccagtgacgaccgcaactttaccttcgagagaaaatgcacttaaaatcataacaataccttattcgtttatgcccacaactagcgcaaatctttaacggccacatggtccatatcatcaaagacctggttttcaccgaccatgccccagataaaggtataagctttggttccgacaccggaatggatcgaccagctcggggagatcaccgcctgctcgttatgcatcacaatatgacgcgtttcttgcggctgccccatcatgtggaaaacgcaggcgtcatcatccatattgaaatagaaataaacttccatccggcgctcgtgggtgtgacacggcatggtgttccacaagttacccggagccagctccgtcagccccatactcaattggcaggtttccagtacatccgggacaaaatatttgttaatcgtgcgacggttactggtgaggttatcgcctaacgtgactggagatacttcgtccggtgtgacttttttggtgggatacgtcgtatgcgcgggtgcgcaattgtaataaaacttcgccggagtgccggtatcaatactggcaaagacaacttcttttgcacctttaccaacatacagggcgtcgcggtgaccgatttcatagcattggccatcgacagtaatcgtaccggcaccgccaatattgataacacctaactcgcgacgttcaaggaaatagcttacgccgagttgtttaccaacttccccgccaacggaaaccgttttagttatcggcataatgccgccaacaataattcggtcaatgtggctgtaaaccatggtgtactcatcggcgacaaataccttttcaaccaaaaattcattgcgcagcccttgggtatccagcgtttttgcgtgcgcactgtggatgctctgtcttacgtccacatcaacctccgataatcagtgaagcgtgaaaatagaaaacgatagtgaaacactgtttcgttttctctataaagggatgatatgcccatgggctagggttttcaattaaaaataaaacaatgtttcatttttaagttaaggattaaaaaaagtgcagtgtcgatcacgaatatgtcatgagaatggaaaaatgagggagcccagaaaatgtatgtcgacttgccagccatcattattcaacagattaatgacggcagatatttatcggtaaggaggaaatgcagagctattcgtcacgttcaatggtcaatgccacaccctggcccccgccgatacaaagcgttgccagtcctttgcgggcattacgtttcaccatttcatgaaccagagaaaccaggattcggcaaccggaagcgcctatcgggtgaccgagtgcgatcgcgccaccattgacattgacccgacgctcatcccactcaagcatcttgccaaccgaaagcgcctgtgcagcaaacgcttcattagcctcgataagatcgacttcagccaactgccagcctacacgctccaggcaacggcgggtcgcatacaccggcgcaattcccatcaatgccggatctacaccaacgctggcaaatgcgcgaatgcgggccagcacgggtaaattcaacgctcgtgctttggcttcgctcatcatcattaccgcagctgcgccatcgtttatggatgatgcattacccgctgtcacagaaccgagactatcaaatgaaggatttaaacgggctaagccttctgcgctggcgtcagtgcgtggctgttcatcggtatcaacaaccaacgtctgcccgttactttgggtcattaccgggacgatctcatctttaaatcgtccggcgtcaatcgccgctcgcgctttttgttgcgagctaagtgcgtaagcatcctgcaactgacggctgatgccatattcgcgagccagattttcggcggtgacaccaatatgataatcattgaaggcatcccacaacccatcatgcacaagactgtcaaccaactggctattgccaagctgtgcaccggtgcggctatcagtcagaacatgtggtgcgcggctcatgttttcctggccaccggcgatgacaatatcagcctcgccacactgtatcgcctgagtagccagatgcagtgctttaagcccggaaccgcaaacgtcattaatagtgattgcagaaacgctattaggcagaccacctttaatagccgattgccttgccggattctgccctgcccctgcagtcaacacctgaccaagaattacttcatccaccgcatatgcaggaacgccggtacgttctattaacgctttcacgaccagactaccaagttccacggcggaatgacccgctaacgcaccacgaaagcagccgataggtgtccgtaacgccccgacaatcacaacgtctttcatcacaacctcgcaccaattaacagtgcaatagtaaatgattgttaattacagttatcttaattgtttaaaaaaagtgatttttatcacaaaggaaatatgcctgagcagcagtcagagacataactggcacgtaaggtttgcaaccactaacccaccaatagaggggtagatagggcgttaatctcccatacttaacctggtttatggtaaattgccctccattttgtttaatttgtagatgatacgttcagataatgtctaatatttggtctaaagaagaaactctgtggagtttcgcgctctacggcacagccgttggtgcaggcacgctcttccttcctattcagttaggttcggcaggggctgtggtcctgtttattactgctctggtcgcctggcctttaacatattggccacataaagccttgtgccagttcatcctctcatcaaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacggaacagctggcaaagcatatggttattgatcttcgcatccgtatgttggtgagtctgggtgttgtattaattctgaatctcatttttctgatgggacgtcatgccactattcgggtaatgggatttttggtattcccattgattgcctatttcttatttctttccatttaccttgtcggtagttggcaacctgatctattaacaacccaggtagagttcaatcagaatacccttcaccagatatggatatcgattcccgtgatggttttcgcctttagccatacgcccattatttctacgtttgccatagacagacgtgaaaaatatggcgaacacgctatggataaatgcaaaaaaattatgaaagtcgcttatctcatcatctgcataagtgtactgttctttgtctttagctgcctgctttctattccaccttcgtatattgaagctgctaaagaagaaggggtcaccattttatcggcgctttctatgctgccgaacgccccagcatggttgtcaatttccgggattattgtcgcagtagttgcgatgtcgaaatcattcctgggtacgtactttggcgttattgaaggtgccacagaggtcgtcaaaacaacactacagcaggttggtgtaaagaaaagtcgtgcatttaaccgcgcactatcaattatgttggtatcgctgattaccttcattgtttgttgcattaacccgaacgcgatttcgatgatttacgcgatcagcggcccgctcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaatatcagttgtggatggttcaaaattgctacaattttgaaccattccatttttcataatattcatttgttattattccaccctatcacttctctcgtcatatcctagtattatcagttagttaaacacacaaagagatctgaacatcttaaataagactatttaagatgcataacttagattcgcaagatatcttctggtcattcaaaaacaatttgcgatatagatattcttataccatgagatagttatctggaccgctctcaaccatgcaagattaaatcagtgaaacataatcatatttgataacgagaaatgcatttttaaatgccttactcagaattatagcaaatacagattaatcgcaatttttcccggcaaaattacaaaatcatggtgtattgacatcatcaataaccaatgaaattatgcaattatatacggatagggaggttcttaacatggggctttgtagtcgttataaaagtcttacatgcaatagttgctcaatgcattgccaaataatgccagaagagtcaccgcgtttgcagtattgcgcaaactcgtgtttttgtatgtggcccgaagaaagttcatattttaatcgtggtgtggtagaaggtatcttaacaaaaaaccacaatgcgagattaagcggatatatttttgtcgatttttcagtaagttttttacgtctattccttgaaaaagactggattgactatcttgcaagtactgacatggggattgttttagtcagcgaccgcaatatgcaatcgttagctaattactggcgaaaacacaactcagcaatatctgctgtcatatataatgatgatggtcttgatgttgccaatgaaaagatcagacaactatttattggtcgttatttatcatttaccggaggtaacacattaactcagatggaattcaccataatggggtatatggtttctggttataatccatatcagattgctgaagttctggatatggatatccgtagcatctacgcgtacaagcaacgaatcgaaaagagaatgggtggtaaaataaacgaattatttattcgttcacattcggtccaacattgatactcaacgaccagccagaatcatactctgtttatacgggcatttattgaaatgtccgtattttataaataggccgtcccctcaagagtaaacaccatagtatttaaaaccatcacacgaaaaattcagaagcattacgaaatatgaatttacaaacaatagtggcataaatgttaaccatgttaatttacgtaaagttttacgttgcaacattaaagcctcatttcaatcatcatgataaatataaaattaatatatatttatgccgtaaataccaatatacttagcaaactatgtgatctccatttcgattgatttagtgtttattgacgtatgtactggattattaacgataatatcgagttctggcctgagcaccgaaaattaatatcggtacataacgccgatcttaacgtcgttctgacaacgccagccagtcgatgtttatcacttctacttgaagcttttcctgatgtggttgcacaacaagattttttcaccagagtctgggaagaagaaggtatgcgtgtgcctactaacacgttatatcagaacatatccattatcagacgcggatttcgcgctgttggtgatactacccactcgctaattgcaaccgtgccgagaagaggattcaagatccataatgacattaacatacaaaatcatgtaataaactcgtcaacagacgcacatacacacaatgccccacctgccataaaagttaatgcgggatacaaagagagcattggtggcgcaaagaatttcaataacaaaatcctcaaacatataaaaagtcatctaattatgttgagcgcatttgtcataggcgcatattctgcatattggctatggaataataatcaaccgaagccatttttcaaggattacaagactgttgcggaaattaatggctgccattttaatgtaacagaagatacaattgatgggttgaaagagttcgataaatataaaacacggatactggattcggggattaactgtaaaaaacatccgtggttatacttccctcttgcaaaatcctcaccggggatgattgttatggcatgcaataaaaactataaccaacatgaagtggcaaactgtttaaccctgtcttaccgtgaggttaatcgtgattgattataaaaaaaacttattatttattttagtttttatcagtgggtttattctcttcactgtctattcttacactgcagaaaaaatgatatataacgaaacatgcactgcaaattgggtaatttttaatgaccagggacgagcaaatcttaccatcgactttatgtataacaaaaaaaataaaacaggaactgttgcgttgagtggaacctggcaacaaggtaacagagaaagtaaatcaatacggcgaaatattgaatacacatggattgaaaactatgacacagcccatttaacatcaaagaaagttaataagtttgagattatggatcaagttgatgatgatagacttgcacaacttattcctgatttttatgtctttccagaaaaaagtgtaagctataatatactaaagcaaggtaagcatgcttttattttgagcattggtaacagagcaataatgcattgtgcaaggtaaactaaaatagataacaaaaagatggaacctcgttaatcataaaacaataaaattaaatattctcgcagtatatggcagtctaaagcatcaaagatttgatcaacatctttcattttagacatctccttgcaatgtaaaatatcatgtatcaacaacatctggtgcaaatccatgagtcgaactcgacattcatcttagctcgattattattccttcgtacagtcgatgtaaacaatacagaaagaggattattaagaaccagtttactcagtgaatcaatagaggaaaggactaacgtttctttaaaagaattgatttcatcatctgttaaactaaactcatcattgacagatcgtgagatataactgtttttaactttactctttacgttgactttattgacagaattaacattcacatatcttgaatttaatgtccatgatgttgtttgcgtgagaacattctcagcattaaggaatttttttaacggaatccttggtttctttttcgagtccgaatttacaatatcatgcatatagaccatttcatgaatctgcgaaaattcaatgtccattgtatacctcacatttttaccgtgactcgatgttactgttcaataatcaccttccatcaatactaaaattaatacccctaatgtgccgataacaaatatagtcattctacgtaacgtctccataaggtgatatttgacattatcagaagctgcgaattcggattttgctctaatcaaatgagagaaatgtaaaatgaagccacgaaatattaataatagcctaccactgcaaccattagttcctgatcaggagaacaaaaataagaaaaatgaagagaaatccgttaatccagttaaaatcacaatggggtctggtttaaattatattgaacaagaatctcttggaggaaaatatctaacacatgatttgtcaataaagatagcggatatttctgaagagataattcagcaagcaatattatctgctatgagcatatataaattttcgataacagatgatttaatgagtatggctgtaaatgaactcataaaactgaccaaaatagagaataatgtagacctgaataaattcactactatatgcacagacgttctatccccccgcgtcaccagacataataaagaaaaaaacaaacgacattctacccttctcaaaaatcccctttttaattttcattgaaaaaatggcaattgatactatgaatccaggtcatacacattaaggcatttatgtaatgtcgtaattaagataactaataaggtgaatattagtaaaacaactaatgatgttattagtttgtagtgaacagtacttttaccaataatgaaaaatataccataagcaatgcaagcttaaaactcataatttaaaaaagataaatataaaaatatcaatgagtcaatcaataataatttggcatcacgagacacatcacagaggaatattatgagcacagaaacaattgaaatattcaataatagtgatgaatgggcaaatcaactaaaacacgcattatcgaaaggagaaaatctggcattactacatggtttaactcctgatatccttgatagaatatatgcatatgcattcgactaccatgaaaagggtaatataacggacgcagaaatttattataaattcttgtgcatttatgcgttcgaaaatcatgagtatctaaaagattttgcatcagtatgtcagcccaaaaagaaatatcaacaagcatatgacctttacaaactaagttacaattacttcccgtatgatgactattcagttatttatcgtatgggtcaatgtcagattggggctaaaaatatcgataacgcaatgcaatgtttctatcacattattaacaattgtgaggatgatagtgttaagagtaaagcgcaggcatatattgaactcttaaacgataattcagaagataatggctaagcattacaatcatttggttaaatttgctggttatagtgcagttaaccactataaccagcacctcttatgttttcttaaatcagcatcttaaaacagttaagagcatactataaatcattatttttcaatgcgttagagaacaatctactttatcaaaattgaataaggctatttcagattacatcactgaattcctaagataaattagtgaacacaaccatagatatgtcaaatgtaatttcctgtagcgttaatgacacataaatatgaatagccataatttctattgcttaagcaggatgcaagaaaccaattttttcatagaggttaactaatggacttagaaaataaattctcatatcattttcttgagggattaacgctcacggaagatggaattcttactcaaggaaatgagcaagtttatattccacagaaagagttaggtgtattaatagtattacttgaatccgctggtcatgttgtactgaaagatatgatcatcgaatcagtatggaaaaatattattgttagtgacgagtccctgacaagatgtatctattctttgcgctgcatttttgaaaaaattggctatgatcgttgcatagaaacaatctaccggaaaggttatcgtttcagcgggcaggttttcaaaactaaaattaatgaagataatacttcagactattccatagctatattccctttcactacttcattgaatacactggatccattaatacttaatcaggaattagtgcaaatcatttcaaataaaaaaatcgatggtctctatacctatccgatggctgcgacaaatttttgtaatgatcacatatctcaaaattcattcttgagcagattcaagccagattatttcgttacaggaagaataaaccagaataatgcagtgaacactttatacattgagttgatcgacgctaaaaaccttttcctcatcgccagtaatcatctccctgttgatgaactacataatacatcacaatttattatagataatatccttcaaacggtacataaaccagaacgatctgtaagattagctaagcaggaccaaggatataagaatcattatttatcagatgaaatgttagccggaaagaaagaactttacgacttcacccctgaaagcatttacagggccatgactatatttgatagattacaaaataaaagtgatatacagacgctaaaaacagaatgttattgccttctagcggaatgccatatgtctttggcacttcatggaaaaagtgaacttgaacttgctgctcaaaaagcattagagcttttagattatgtatcagacataaccactgtcgatggaaaaattttagctattatgggactgataactggtctgtctggacaagcaaaagtatctcatatcttatttgaacaggctaagatacactcaactgatatagcctctctctactactatagggcactagtccactttcataatgaaaaaattgaagaggcaaggatttgtatagacaaatcactacaactcgaacccagaagacgaaaagcagttgtgataaaagaatgtgtagatatgtatgtgcctaacccgctcaaaaacaacattaaactctactataaagaaactgagagtgaaagccatcgagttataattgacaacattttgaaattaaagcagctgacgagaatttgtatgcgataaatttttattgacgcaattttattatttagatgtatgcaacttgttatttaaacaacagagataaaaatatctaagatattcaccttattgcaagatatttaaaatgctctagagttaaaagtatgatgtaaagaccattggcctggacaattaaaaaagggagctttatgactaatccaatcggtatcaataatttatctcaaagttcaaatatagcgaatgcaacgggtgatgaagtcgtatcattagataaacacatcaacaccagtgctactgatacagatcaaatacaagcatttatagtttcaacatggatggcgccttttcaaaatgatatgtattcagaagataatcctatctcaccttactataaaattgagtggtagacgattgaccaaataaatcataacgagatacttttataatagtatctcgttcctttcattcaatcctcacacatgaaaaaatatgcgctcaccaaaagttaaattcttaaccatcttcacgttttgtatatttattacaaaaatgtctttcgccagcaactcttgctctaatgaagcaggaacaatgttcagaatcgaaccaaatttaattaaagctatcgctcttgttgaaagcaatctaaaaaaggatagcataggcaagaacagagataagaataacaatataaagagtttagattattggttaatgcagataaaccagatgcatattcccctgttaaaaaaacgtggaataataaaagatgaacgagatttgttagataacccttgtctgaacattaaaataggaaccgagattttatataaccatttttcacgttgtggagtaacgtggcaatgcctggggacttataatgcgggttttgcaatggataaccaaaaaaagagacagcaatatgccccaaaatatatattgtatataccaggcttaatgaactagacaatcgtaaggcttcagcaaaatgagcctaaagcctcttttttttatatagtgcaaacacccatacgtaaagctgttttgatcaactcgataccactgtgaacatctaatttcttcatgatattgagtctatgagtttcgactgttttcctgcttaactgcaagaaattagcgatttctttgtttgttttaccatcagctatgagttgtaatatttctgactcacgatttgtaagttgattatcagaggaatacctggaagatattttttcacaatccatatgtacactatcaaaataagtgtaaccattactaatcgaatcaatagcacgatttagtttcgccgggtgactggttttccatacgcatcctttcgcacctgcttcaagcaattttattgaatcaatatacggcatctttgctacaaatgtaataatatgagcatctatcttatgcgatttaacccattttacgagttcggcccccatcattccacctgcaaattctcctaaaataaatatttaggctgtagatttgttacactccgctatagctttcttcagatctttatagcccccaacaacctcatataaatcaggataatgtccgagaaatccaattatcccatcaatcataaacggctgctgatctgaaactacaattttaatttttcccatatattcatcctgagtgtaaatgctttaacgcattcatttataatcatcccttccattattattataagcaaaatccaaagaatacattgatgaaataataatgaaatataattaaaaataaaatttttgcgtaaaaaaataccacaggcattaaaaaatcatgagatgattaaaatattacaattagattatattcaaatcattaaacttgagccagggagctataagtcctcagggcttgccaaaacagaattattcatatccaaagaatgtgtttcaaacattttttcaactaaataatgtctggcttgttcgcagatttcgttaaccttgtcaggggagaaacaatgattattaattaaatattgctcacaattatccacaaattcctgcggactaaattcagcaataaattgatcggtaaaaaacacaaaacgcttatcatcatgaaatgtaatatggacattccatattgatttgtcgacaaaatatgactctacttcaagagacttatctttgaaactggtaggtatatggagatttacaggacctgatattgatggtaattttgttacccaactttcaaaaattttgataaaaacatcaacttcttctgaaggttttaacaatatactcttcagatcgtttatcatgtttattcttttttttcaagttctgagcatagcaagcttatcaagggtataaaattatccatctcatcaataatgccttttgtatagccatcataataaccttgaataaatttttcttctctcttttcctcaatactctgaatttttgcggtggtttcaagaaggattttttctttaagagaaactatttctttcaatccatcagaaatttttcttttaatcacaacaccatttgcaggagattttatcaagctcatctctattttttttcgcataaaatgtaattctctctaaaagtgttgatgcaagtggtaacggcgattgtatgtggtcaacaaaatcaggaaataataaattaaatcgttgctgcattgccaatggttgttgccttatatagggtaacaacgttgaaaaaccacatgtgatgatattgtgatagttagcgatgccgggtttgtatcgtgccttttcatttatttccagcggtatagctgataaataatcccttagtacatcaggaaccttataaaaaaacccgcgttctgcaaacctttctcgataaaagtgacaaccactgagtaaacagatcaatggaagtaaattccaattgtttattggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaacttgctcttttcttctggtgtttatctttgaaagatttgtaggataaataacattaagtaaagccgcatcggcttctctgtaatgtttatctttttccagataacctggggattctccccctaaatcaagctgtaacgttattctttcataacctttatctatgaggtggttcaacctcgttgttgaaagagtttcatccagttcattgactttagcttcgcgtagtaaatcagagacaaaaacagagtctttcttcgagagtaggtttgacaaacgttccagtccagaggtcaccagtgcaacggaagatgtgtttaatcgggcatcttcttcccatgctcaggaatcttccataacatagaaattggctttatccagataagcaatcagcagcgcaaccgactttaatcggtcacctttttgccaatcttcagcgttaatagtaccagtgttgattgcttgtataaggagatcaaggtaaagacctaaagcatcattttgtttatggttccacagctgcggcttgccttcttcctgcacatctgccatcacgggggagttgctgtcaaatcggatatgcacagcattcatttgcacgggaattccatccagtcgttttgggttgctaatgacgtcctgcatccgcttaatctggtcgggcgtagacatataatcccacagggtgagcagaaccttttttgcggctacactatttccctgatctgatactaatgccatatagccccataaactatccctcaaccagacagcatcatagtgggtttctgccgctgttttgtcatcttcgaaagtagaagcaagaataaacgttccccagggtttctccgtcaacgttaactttcgtgtgttttctgttaatgttagcaatccttgaatttcgtctttggtatagtggctctttatttcattttgtaatttggctgagtgaatcagaagacgataattaggatacttatctggatttaacgataaataacttttatctgttgctgcccccgtggaattaagaatgttaaatacagattcactcgtcacttctgcccctgtcgcctggcatgtgccgcacgaaaatataccagcgagcagaagagttaatgcagatttccctttcataaaatattccatcaatcgtttgttaaaagcgtagataaccacttatttaacaacttgaaaataaggtgttttacctgggttgttacaaaaggattgcattgcgtaaacgctttttatttacaacaaaatggggaagtattacggcgaagataaattggagcgggcgaagggaatcgaaccctcgtatagagcttgggaagctctcgttctaccattgaactacgcccgcttcgagatgcgtaaggcattataaaccttacgctctccttagcaagtgccacgctgctgactgctgattaattcgccatcagcattttggcttgctgccctgaggcggcaagtaacgtagcggatcaattgccgttgcacggtaacgaatctggaaatgcaggcgaacagatgccgcatccgtgctccccatagtggcgattttttgcccagccttcacgctttgcccattatttaccagcatcgtgtcattatgggcgtaagccgtaatgtaatcttcactgtgtttaatcatgatgagattaccgtagccacgcagctggttgcccacatacaccacctttcctgcacccgcggcgtaaataggtgtaccccgtggagctgagatatcaatccctttattgccgccatctgctgtcgaatacggcatgataactttccctgtcgttggccataaccaacaacgttgccctactggcggccaggatgatttcggtaccgctgatgacggtgtaaccgatgcggttttggtcgttgatttggcggttgatttacgtgtaatactgctacttttcgccccacccagttttagtttctgaccaacttcaatggtgtaagggggggaaatgccgttcagtcgcgccagttcttttacgctggttcccgtggtgcgcgaaatacgatatagcgtatccccccgtttcacggtgtaaacggagccggaatacgttcctgtatcggatgatttgctacccgaacagcccgccaaaagcagtccaaccgataacaacatcacgatacccagagattttttattcaggcgtcccgcactcaaaatctttcctcgcttaaaaaacaagacgccttatcatagcagccagcctcttgatacccaatctcttgcttctggaaaaacgtggtaatagagaaagaggttaatttcatttggcaaagggaagtatcatcagcaaaatattcgctgtagaggtatcgaacttcctgactttttaccctatttcccatcctgatgcgtaataatcccaatttatcacattgattttatcgccactcatattgatacgtatcactgcccctattcagagtcctgtttcgtatcatatctgtgtttttttaacgtcatcacacttcctacctcccctaacgcttatcgtcgtttctggcgtaaatcttgcctgcttagactaaatctttgccataagaaccaaatgttcaaatcgaggggatttctatggaagcgcgggaagcaaccgctacgggtgaatcatgcatgcgcgtcgatgccattgctaaggtcaccgggcgggcacgatatactgacgattatgttatggcgggcatgtgttatgcgaaatatgtacgtagccctatcgcacatggttatgccgtaagtattaatgatgaacaagccagaagtttgccgggcgtactggcgatttttacctgggaagatgtgcctgatattccattcgctacagctgggcatgcctggacacttgacgaaaacaagcgcgataccgccgatcgcgcactgctaactcgccatgttcgtcatcatggtgacgccgttgccatcgtcgtggcccgcgatgaactcacggcagaaaaagcggcgcaattggtcagcattgagtggcaagaattacccgttatcaccacgccagaagcggcgctggcagaagacgctgcaccaatccataacggtggcaatttactgaaacaaagcacgatgtcgacgggtaatgtccaacaaacaatcgatgccgccgactaccaggtacaggggcactatcagacccccgttattcaacattgtcacatggaaagcgtaacatcgctggcgtggatggaggatgactcgcgaattaccatcgtttccagcacccagatcccgcacattgttcgccgcgtggttggtcaggcgctggatattccctggtcatgcgtacgagtcatcaaaccatttgtcggtggcggttttggtaataaacaggatgtactggaagagccaatggcggcattcctgaccagcaagcttggcggcattccggtgaaagtttcccttagccgtgaagagtgtttcctcgcaacccgtacccgccacgcttttaccattgacgggcaaatgggcgtgaaccgcgacggaacattgaaaggttatagtctggatgttctgtctaacaccggcgcttatgcatctcacgggcactccatcgcttctgcgggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgacgccgcgacagcgttaggtattgatcctgttgaaattcgtttacgcaacgccgcccgcgaaggagatgctaatccgctcacgggcaaacgtatttacagcgcagggttgccggagtgtcttgaaaaaggccggaaaatctttgaatgggaaaaacgccgtgcagaatgccagaaccagcaaggcaatttgcgccgcggcgttggcgtcgcctgttttagctacacctctaacacctggcctgtcggcgtagaaatagcaggcgcgcgccttctgatgaatcaggatggaaccatcaacgtgcaaagcggcgcgacggaaatcggtcagggtgccgacaccgtcttctcgcaaatggtggcagaaaccgtgggggttccggtcagcgacgttcgcgttatttcaactcaagataccgacgttacgccgttcgatcccggcgcatttgcctcacgccagagctatgttgccgcgcctgcgctgcgcagtgcggcactattattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgctgaaagctccatcaaaaccaccactaacccaccggcgtttggctgtacctttgttgatctgacggtcgatattgcgctgtgcaaagtcaccatcaaccgcatcctcaacgttcatgattcagggcatattcttaatccactgctggcagaaggtcaggtacacggcggaatgggaatgggcattggctgggcgctatttgaagagatgatcatcgatgctaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccaccaataattcctgttgccgctgctattcgtaacgcggtgaagatggctaccggtgttgcaatcaatacactgccgctgacgccaaaacggttatatgaagagttccatctggcaggattgatttgaggataacatcatgtttgattttgcttcttaccatcgcgcagcaacccttgccgatgccatcaacctgctggctgacaacccgcaggccaaactgctcgccggtggcactgacgtactgattcagctccaccatcacaatgaccgttatcgccatattgttgatattcataatctggcggagctgcggggaattacgctggcggaagatggctcgctacgtatcggctctgcaacgacatttacccagctaatagaagatcctataactcaacgtcatctcccggcgttatgtgctgcggccacgtccattgctggaccgcagatccgtaacgtcgctacctacggtggaaatatttgcaacggtgccaccagcgcagattctgccacgccaacgctaatttatgacgcgaaactggagatccactccccgcgcggtgttcgtttcgtcccgattaatggctttcacaccgggccgggcaaagtgtctcttgagcatgacgaaatcctcgtcgcctttcattttccgccacagccgaaagaacacgcgggcagcgcgcattttaaatatgccatgcgcgacgcaatggatatttcaacgattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagctatcagcgaatctgtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcaccaggcacgccgctctcggaattactccgcgaacaaggactgctaagtgtcaaacaagggtgctgcgtgggtgaatgtggtgcctgtacggtgttggtcgacggcacagcaatagacagttgcttataccttgccgcctgggctgaaggaaaagagatccgcacgctggaaggtgaagcgaaaggcggaaaactttctcatgttcagcaggcttatgcgaaatccggcgcagtgcagtgcgggttttgtacgcctggcctgattatggctaccacggcaatgctggcgaaaccacgcgagaagccattaaccattacggaaattcgtcgcggactggcgggaaatctttgtcgctgcacggggtatcagatgattgtaaatacagttctggattgcgagaaaacgaagtaaaaggatatccggcctgaattcaggccggattcactgaggttatgtgtttaacaactcatatttcttaatcttgcgatagagcgtagcaatgccgatgcccagttcatcagcaacttgcttcttgctgttatgacgtgaaagcgcctcgcggatcatttgcttttccatctcctccagcgccgtgccgcccgcatcatcgagtgacaggtgcgcctcactgacctctgttacatcactttgctccgttgtgccattattcagcagatttggcggcaatagcgtgctgtcgataacttcacctgaaggaaccacgttaaccagatattccatcaaattgcttaactcgcgcaggtttccgggccaacgatgcttacgcaatatttcgacgacatcgggagcaatgccaggataaaccgatcccagacgacgggtatgcagatgtaaaaagtaatgcaccaatagttcaatatcttcctgacgttcacgcagcggtggcagagttatcgggataacattaagtcggtagaagagatcttcgcggaatttaccttcggcaatgaactgggccaaattctgattagttgcagaaatgatgcgaatgtcgacttgtattgggctactggcaccaatcggcagaatttcacgtgcctcaatagcgcgcagtaatttagcctgcaacattaatggcatatcacctatttcatcgagaaacagcgtgcccgtattcgccgcctgaatcaaccctgttttaccgttggcagaagcgccagtaaatgcacctttaacataaccgaacagttcgctctccagaagctgctccggaatcgcggcacagttgatagcaataaagggtttattccgtcttccgctcaacttatggattgcacgggcgacgacttctttacccgtgccgctttcaccaaccaccataacgctggatgggctgggtgcaatacggctaatgagtcgttttaattgccgcataacacggcactcgccaaccaattgttcaatatgcggttcatcaggtgcatttgctacagaaaaactggtatgcgattggtgaaacgccattaaaaataattgtcggccctgaatgttatgcaattgaccaatgattaattcacttttatcgtcccatgaaacaatatgctgcatatgtccatgggtaaaattactctcaaatgttaatggtctgaaacggataggtttcccaataatattattttgcacaacaccaagtgtttttaaggcagtctgattaacaaactgaacccgattttcatcatctacaactaatacgccctgatccatattatcgatcatggtcgcaaatattttactgatgttatctcctggcccctgatcctccagaagtttcgaaacaaaaatggtggatatatggcgaacataatcagaaaattcgcgtaaattatcactgatatgctcttgttgctcgtgggtaacggcaatcaaacttatcaccccaacacaacgatcctgtaaaatgacaggcgtacccagaaatgctttttcgcggcaattttctttactatcgcaaccttcgcaaaggggatcgaagcgagactgtgtcacaactttttcagttttcgtttccaggacgtggcggagcaggcgtgagttgccgctcaactggcgaccaagaaacttcccatacgcgcccgttccggcaacgcgacacaagttttcatcaacgatctcaacctcaagctgcaaaacgctggcaagcattctggcaaaacgctgaattgtcggttgaatttgcatcaatactgactgcgtagtagcaagctccatagctttaccttccagacttacttaaaagtcgatcattgaagacgttgatggttcacagatcatgatgatattaactcaggcgaaattggctttgataaaaacataagatttttatcattttctaatgaaattatggaagagatatcacatttctatatcaatatgagaattacggcggtgagtttatcaaactgaagagagatagcctgcccctttatcttatttctgatacttagcagcaaataaataacgcgataaaaaaagccaaacgttttcgtattttacaaacaaccagaagctggcatcaatttgtgatcaaccccacacattatccgtcaaattagtcttttgcagccgcgcggataattctggcacacttattgttagtcccaggtatagctgtgaaaacaccaatcactttggcaagtcacagtgaaataaaccactttgcctgtcattccactaccgggactttatgatgaaaactgttaatgagctgattaaggatatcaattcgctgacctctcaccttcacgagaaagattttttgttaacgtgggaacagacgccagatgaactgaaacaagtactggacgttgccgcagcattaaaagcactgcgtgctgaaaacatctcaaccaaagtctttaatagtggattaggtatttccgtattccgcgacaactccacccgtacccgcttctcttatgcttccgcgcttaacctgctcggccttgcacaacaagatctcgacgaaggcaaatcacaaatcgctcacggcgaaaccgtgcgtgaaaccgccaatatgatctccttctgcgccgacgctattggtattcgcgacgatatgtatctgggcgcaggcaacgcctatatgcgtgaagttggcgctgcacttgatgacggttacaagcagggtgtactgccacagcgtccggctttagtgaacctgcaatgcgatattgaccacccgactcagtcaatggctgacctcgcgtggttacgtgaacactttggttcactggaaaacctgaaaggtaaaaaaatcgccatgacctgggcctactctccaagctatggcaaaccgctctctgtaccacaaggcatcatcggtctgatgactcgcttcggtatggatgtcaccctggcccatccggaaggctacgacctgatcccggatgtggttgaagtggcgaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgtaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataacccctcgggccgatcagctggtcggccctctatttccagaggccaaaaggataggatatgtccgttttctcattgaagattgatatcgccgataacaaatttttcaacggcgaaacatcaccgctcttttcgcaaagccaggccaaactggcgcgccagttccaccagaaaatagctggttatcgcccaacaccgctttgtgcgctggacgatctcgcaaacctttttggtgtgaagaaaattctcgtcaaagacgaatcaaaacgattcggtctgaacgccttcaaaatgcttggcggtgcgtacgccatcgctcaattattgtgtgaaaaatatcatcttgatatcgaaacgctgtcatttgagcacctgaaaaatgccatcggcgaaaaaatgactttcgcgaccaccaccgacggcaaccacgggcgcggtgtggcgtgggcagcacagcaactcggacagaatgcggtgatttacatgccgaaaggttctgctcaggaacgcgttgacgccattctgaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaaccctggcagatgaagccgtcgagcaaatgcgtgaaatgggcgtaaccccgacgcacgttctgctgcaagccggtgtcggagcaatggccggtggtgtgctgggttatctggtcgacgtctatagcccgcaaaatctgcacagcattattgttgaacctgacaaagctgactgtatttatcgctccggcgtcaaaggcgacatcgtcaacgttggcggtgatatggccaccatcatggcaggcctggcctgtggcgaacctaacccgctgggctgggaaatcctacgtaactgcgccacccaattcatctcctgccaggacagcgttgccgcattaggtatgcgcgtgctgggtaatccgtacggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaatcaccctattggaactgctccctgcaaaacggggagtaaaaaatctggagaaaaataatggctaagaatattccattcaaactgattcttgaaaaagcaaaagattaccaggcggatatgactcgcttcctgcgcgacatggttgctattcccagtgaaagctgcgacgagaaacgcgtagtacatcgtattaaagaagagatggaaaaagtcggcttcgataaagttgaaatcgacccgatgggcaacgttctcggttatatcggccacggcccgcgtctggtggcaatggacgctcatatcgataccgtcggcattggcaacatcaaaaactgggacttcgatccgtacgaaggcatggaaactgatgaactgattggtggtcgcggtacttccgaccaggaaggtggcatggcctctatggtttatgccggtaaaatcattaaagacctcggtctggaagatgaatataccctgctggttaccggtacggtgcaggaagaagactgcgacggtctgtgctggcagtacattattgaacaatccggcattcgcccggaatttgtggtcagtaccgaaccaaccgactgccaggtataccgtggtcagcgcggtcgtatggaaattcgtattgatgttcagggtgttagctgccacggttctgcaccagaacgcggtgataacgccattttcaaaatgggtccgattcttggcgaattacaagaactctcccaacgtctgggttatgacgaattcctcggcaaaggcaccctcaccgtttctgaaatcttcttcacatccccaagccgttgcgctgtagcagacagctgcgcagtttcaatcgaccgtcgtctgacctggggcgaaacctgggaaggcgcgctggacgaaatccgcgccctgcctgcagtacagaaagctaacgcggttgtttctatgtacaactacgaccgtccgtcctggactggcctggtttacccaaccgaatgctacttcccgacctggaaagtggaagaagatcacttcaccgttaaagcactggtgaatgcctacgaagggctgtttggcaaagcgccggttgttgataagtggaccttctcaactaacggcgtatctatcatgggccgtcacggcattccggtgatcggctttggcccgggtaaagaacctgaagcgcatgcacctaacgaaaaaacctggaaatctcacctggtgacctgtgccgcgatgtacgctgcaatcccgttaagctggctggcaacagagtaattactcttcacttattcccctccggttcgccggagggtttttggagtttgctatgcgcgtattgatcaaaaacggcactgtcgttaacgcagatggacaagccaaacaggatttgctgattgaaagcgggattgttcgccagttgggcaacaatatttcgccgcagctcccgtatgaagaaattgatgccactggctgttacgttttccctggcggcgtggatgtccatacgcatttcaatattgatgtcggcatcgcgcgcagttgtgatgatttttttaccggtacccgcgcagctgcgtgtggcggtacaacaaccattattgaccatatgggatttggcccaaacggctgtcggttacgccatcaactggaggtttatcgtggttatgccgcccataaagcggtcatcgattacagctttcacggtgtgatccagcacattaatcacgcaatcctcgacgaaatcccgatgatagtcgaggaaggactgagcagttttaaactctatttaacctatcaatacaaactcaacgatgacgaggttttgcaggcattacgccgcttgcatgaatccggcgcgctgaccaccgtgcacccggaaaatgatgcggctatcgccagcaagcgggcggaatttatcgccgcagggttaaccgcgccgcgctatcatgccttgagtcgccctctggaatgcgaagcggaagccatcgcccgcatgattaacctggcacaaattgccggtaacgccccgctctatatcgtgcacctgtctaacggcttaggtctggattatctgcgtcttgcccgtgcgaatcaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggctcaacgcctgcaaatttctaaaggcgatttcagtcgctgcccaaatggcttacccggtgtggaaaaccgcatgcagttactgttttccagtggcgtgatgacgggacgtataacaccggaacgctttgttgaattaaccagcgcaatgcccgccaggttgtttggcctgtggccgcaaaaaggattattagcgcccggttccgacggcgacgtggtgattatcgacccacgtcagagccaacaaattcagcatcgccatctccacgacaacgccgactactcgccatgggagggttttacctgtcagggcgcgattgtcagaaccttatcccgtggtgaaacgattttctgtgacggcacctttacaggcaaagccgggcgaggtcgtttcctgcgacgcaaaccgtttgtccctcccgtgctctaaccactgccagggatctatacacaatcaagaatgatgagtgaggaaaaatgagtaagaaaattgttctcgccctgggcgggaatgcgctgggcgatgacctggccgggcaaatgaaagcggtaaaaattacttctcaggcaattgttgatttaattgcccagggacatgaagttatcgtcactcatggtaacgggccgcaggtgggcatgattaaccaggcctttgaagctgccgcaaaaactgaagcgcactcgccaatgctgccgatgtctgtctgtgttgcattaagccagggttatattggttacgatctacaaaacgctttaagagaagaactgctttctcggggcattaataaacctgtagcaacgctggttactcaggtcgaagtcgacgctaacgatccggcattcctcaacccgaccaagccgatcggttcgttctttaccgagcaagaagcagagcaactgacaaaacagggttacactctgaaagaagatgctggtcgcggctatcgccgtgttgttgcctcgccaaaaccggttgatatcattgaaaaagaaacggttaaagctctggtagatgcaggtcaggtggtgatcaccgttggcggtggtggtatccctgttattcgtgaaggtaaccatctgcgtggtgccagcgcggttatcgataaagactgggccagcgcccgtttagcagaaatgattgatgccgatatgctgatcattctgactgcggtagaaaaagtggccattaacttcggtaaagagaatgaacagtggctcgatcgcctgtcattaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaacaggaacggtgatttgtcagtaatttaaaggccgggtgggtaataccatccggccaaagattgtcaagtaagtgcgctttgttgatgccggatgcggcgcgagcgccttatccgtcctacaaaacatcgcaaattcaatagattgcaatgcacttgtaggcctgataagcgtagcgcatcaggcaatttggcgtttgtcatcagtctcaggccgggtgggtaataccatccggccattttcatttaagccacttccagcacttcttttgtcgctttcacgccctgatgcatcaacatcattaacgcctcaagtacgccgccgccaatcgcccgggctttatcagaaacgctggtgaaatcagcggtttcaccacgaggatcgatatcaccaattttaaaaccaccaaccactgccaggccgtcgttcaacaagccacgcaccatccccgtcaacggtgctttaatttcatgctcaccaatccaggcaatcacatcgccctctttcaccagatcgcctaatttcacgttggatcgcataatgcctgcagcaggagcacggatcacccgtcgggtggtatgccccataatattgccaggaacaccggtattctcctgcgcacaaccagagtaaatcacctgaccgagccagtgcccgcgatttgtttcaattaccgcatgacaatccttcccagcagtaaagcccggcccaagcgcgattgttactggtgccatatctgcccgcgttcccaaattctgtttcgccagaatagcgtccaccacgcaaagcggtttcagttcatcaagcaatgaacaggcgggatctaccatcacaggaatgaatccgcgttcggtaagtttcatcgcttccgcagagctggttgccaggcgagcagtgacgccttcgaccgtcatttcgccatcgaacacggcctgggcaaacgccacggtacaacgaatcactgtcggtttttccacttccagcatgatcactttaaaacccgcatgatacagacgtagcgccacaccactggcgatatctcccgcaccgcgaatcaccaccagctggtgtccggaaggatgagaaggtttcatcatcagcccacccggcgcgttatttttcacctgtaatatttctgccagcacgctgatggcgatctcctgcggcgtttccgcacctatgttgtaaccaacgggcgcatgtaaacgggcaatatgttcttcagccacgcctttctcacgcaattgacgcaggaaaagctgaaccttgcgacgacttgccagcaaccccaaccatgcaatgggctgttcaatgagtttgtcgagggcttcacgatcctgattattcgtggcaatcaggacaaaattatcagggcgaatatccagtgcttccactgccgcaccaaacgactcagcatggagaagcgtggttgatggtgggaatagttcaggattgaggctttcgcgataaatatcagcaacggcaatatcaaatcctaatagcgccgcactctgggctatcgcccggttgacatgccccgcgccaatcaacaccagacgtggacgcataccatggacgctgataaatactgacattgcacctccacaatctgacccgacagcatccgcaccgttacgagccatacgtccatggaataatcgcggcttacgttcctgcaatgcctgaagcgactcttcaatcaccttccgctcaaccattccgccaccaattgtaccgacgatagaaccatcggcgcgcactaacatttgtgcagaatggcggggagtcgagcctcggctatcaacaatttgcgccatagcaaacggacaattttgctcttcgagttttgcagcctctgtgaaaatattcataccaacctcaatggatatcctttcagtaacccggaatacccgggccgctaattcacaaatctgcgcgcgattgcaggatgttcttgtatatcgcccagccagattgcctctacgtcgtgttgttgcagcggttgaaggagctcgctttgtgcaatcgcattctcacattgagaaaaacggttaatgaaccagactcgccgacaaccttgcggtacgtttttaaacgccccctgagggtggcgaaccagcgcaacgagatcgctcagttgcaaggttgcatcaggtgttaacccggtaatatcagcaaactgcgaccagcgatggacattttctgtgctcactttcgcgcccaaagtatgtcctcccatcacagcaatcacgcagcaactgcttttgggtatgcaaggttcgtgctcatcaggcgcttttaacggcattccacgcgagccatctgcttcaatgagaattacgtcacactctggtcgttgcaccagtgcatcaatcgcttctggcgtaaatccctgcacttttccctggttcgctttccagctgtgaaaacaaaatgaaatgggggatgtaagagacgcatgaggaagcatggcgggatcacgacagaaaaccacgggccagtgagacgttggcataaacatatgtgtcgtcgtcgtgattaacacacgcctgccgctagcctggagcagttctgccagccaaaaaagcaagctggttttccccccagcaccaacaacagaaatcacagtgggacgtttctgcgcacctaaatcaatgactaatgccgatgggtcaactatacttttcacgagtctttatgacctctctgggataaattatccccaacttaatccatcaggaagtaacgcaattatcaggcgttattagcccctataaataatggaaccactatgtcagccatcgactgtataattaccgctgccggattatcatcaagaatggggcaatggaaaatgatgttaccctgggaacagggaacaattcttgatacaagtatcaaaaatgcgttgcagttttgtagccgaattattttagtcaccggctatcgtggtaatgaactgcacgaacgttatgcgaaccagagcaatatcactattattcacaacccagattatgcgcagggtttactaacatccgtcaaggccgcagtacccgcagtgcaaacagaacattgttttctcacccacggtgacatgccaaccctcaccatcgatatttttagaaaaatctggtcgttacgaaatgatggcgcaatactgccactccataatggcatccccggccatccgattttagtgtcaaaaccatgcctgatgcaggcaatccaacgacccaatgtcaccaatatgcgtcaggcactccttatgggagatcattattccgtcgaaatagaaaatgcagaaataattttagatattgatactccggacgactttattacagcgaaggaaaggtatactgaaatttagaaaacgtagttaaacgattgcgttcaaatatttaatccttccggcactcattatcataatgataaggaatcactgattttgagaaaagagaaaaattgataaatgggctggcaataataattttcaggagtgattttaattctcatttagcacctgtgagttcattcacaaaaagcccttaagtttcgagccgcctcacatttttttatatttcccgccaaacctggcaagagtggtgcgattgttgctctatccccctaaaccaccggatttctcaacaccggtcactcaatgatatctgtataagctaaggagagggttatgggggatattatgcgtcccattccgtttgaggaacttttgacgcgcatatttgatgaataccaacaacaacgctcaatctttggtattcccgagcaacagttttactcacctgtaaaaggtaaaactgttagcgtcttcggtgaaacctgtgccactcccgtcggccctgccgctggcccgcacacgcagctcgcgcaaaatattgtcacttcctggctgactggcggacgcttcatcgaactaaaaaccgtccaaattcttgaccgcctggagctggaaaagccctgtatcgatgccgaagacgagtgctttaacaccgaatggtctaccgagtttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcaacagttcatcgacaatatgatggacgcatctgaccatccgaaattcgctcaatatcgcgatacgctgaataaattactccaggatgacgcatttttagctcgccacggattgcaggaaaaacgcgaaagcttgcaagccttacccgctcgcatccccaccagtatggtgcatggcgtcaccctctccaccatgcacggctgtcctccgcatgaaatcgaagccatttgccgctacatgctggaagaaaaagggctcaacacctttgtgaaacttaacccgaccttactggggtacgcgcgtgttcgtgagatcctcgatgtctgcggtttcggttacataggcttaaaagaagagtcatttgatcacgacctcaagctgacgcaagcactggaaatgctggaacgcctgatggcactggcaaaagaaaaatcactcggctttggcgtaaaactgactaacactctcggcaccatcaacaataaaggcgcactgcctggtgaagagatgtatatgtcaggccgtgcgctgttcccgctctccatcaatgttgcagcagttctctctcgcgcctttgacggcaaactgcccatttcttattccggtggtgccagtcagctgactatccgcgatatttttgatacaggtattcgccctattactatggcaaccgacctgctgaaacctggcggctatctgcgcttaagtgcctgcatgcgcgagctggaaggctccgacgcctggggacttgaccatgttgacgtcgaacgactgaacagactggcagcagatgcgttaaccatggaatacacccagaaacactggaagccagaagagcgtattgaagtggcagaagacctgccgctgaccgactgctacgttgccccctgtgttactgcctgcgctatcaagcaagatattccggaatacatccgtctgcttggcgaacaccgctatgccgacgcgctggaactcatctaccaacgcaacgctctgcccgccattaccggtcatatttgcgatcaccagtgccaatacaactgtacccgcctggattacgacagtgcgctgaatatccgcgaactgaaaaaagtcgcgctggaaaaaggttgggatgaatataagcaacgctggcacaaaccagccggttctggttcacgccatccggttgccgtgattggtgcaggtccggcgggtctggcagcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgctcacggcgtgaaatttgagtatggctgctcacccgatttaaccattgagcagttaaaaaatcagggcttccactatgttctgattgccaccggcactgataaaaatagcggtgtgaaactggcgggcgacaaccaaaatgtctggaaatcactccccttcctgcgtgaatacaacaagggtacagcgctcaagctgggcaaacatgtggtcgttgtcggggcgggtaacaccgcaatggactgcgctcgtgcggcgttacgcgttccaggcgtagaaaaagcaacgatcgtttaccgtcgttcactacaagagatgcccgcatggcgcgaagagtatgaagaagcgttgcacgacggcgtagagttccgtttcctgaataatccggaacgtttcgatgctgatggcaccttaaccttgcgcgttatgtcgcttggcgaaccggatgagaaaggtcgtcgtcgtccggttgaaaccaatgaaacagtaacactgcttgtagacagcctgatcaccgccattggtgaacagcaggatactgaagccctgaatgcgatgggcgtgccgctggacaaaaacggctggccagacgtcgaccataatggcgaaactcgtctgactgacgtctttatgatcggcgacgtacagcgcggaccatcctccattgtcgctgctgtcggaaccgcgcgtcgggcgaccgatgccatccttagtcgggaaaatatccgttcccaccagaacgataaatactggaacaacgtcaatccagcggaaatctatcaacgtaaaggcgatatctctatcacgctggtgaacagtgacgatcgtgacgcgtttgtcgcccaggaagccgctcgctgcctcgaatgtaactacgtttgcagcaagtgtgtggatgtctgcccgaaccgcgccaacgtctccattgcggtcccaggcttccagaaccgtttccagacgctgcacctcgacgcttactgtaacgaatgcggcaactgcgctcagttctgtccgtggaacggtaaaccgtacaaagacaaaatcaccgtcttcagcctggcgcaagactttgataacagcagcaacccaggcttccttgtggaagattgccgggtacgagtacgtctgaataaccaaagctgggtgttaaacatcgacagcaaaggtcagtttaacaacgtaccaccggagctgaacgatatgtgccgcatcatcagccatgtccaccagcatcatcattatctgctgggccgcgtggaggtgtaatcatgttgattctgaagaatgtcactgcggtacagctacacccggcaaaagtgcaggaaggcgttgatatcgccatcgaaaacgatgtgattgtcgctatcggcgatgccctgacgcaacgctaccccgacgccagcttcaaagagatgcatggccggattgtgatgccagggattgtctgctcgcacaaccatttttactcggggctttcccgcggaattatggcaaacatcgccccttgcccggatttcatctcaacgctgaaaaatctctggtggcggctcgatcgcgcccttgatgaagagtcgctctattacagcggactgatttgttccctggaagcgattaagagcggatgtacatcggttatcgatcaccatgcctctccggcgtatatcggcgggtcgctctccacattgcgcgacgcatttttaaaagttggcctgcgcgcgatgacctgttttgaaactactgaccgtaacaacggcatcaaagagttgcaggaaggtgtagaagaaaacatccgtttcgcccgtttgattgatgaggcgaagaaagcgacaagcgagccgtatctggtggaagcacatatcggtgctcacgcgccgtttaccgtgccggatgccggtctggagatgctgcgtgaagccgtgaaagccacaggccgtggtttgcatattcacgctgcggaagacctttacgacgtttcctacagtcaccactggtacggcaaagacctgctggcacgactggcgcaattcgatctcatcgacagcaaaacgctggtcgctcatgggctgtacttgtcgaaagatgacatcaccctactcaatcagcgcgatgcgttcctggtgcataacgcccgttcaaacatgaacaaccatgtcggctacaaccatcaccttagcgacatccgcaatctggcgttgggaacggacggcattggttcggacatgtttgaagagatgaaatttgccttctttaaacatcgcgatgcgggtggtccgctgtggcctgacagttttgccaaagccctgactaacggtaacgaactgatgagccgcaactttggcgcgaaatttgggcttctggaagccggttacaaagctgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcacaagccagaaaagccgctgccagtatgtggcgtcggatggatgcgctggcataaatgacagatgccctcttcccgcagggaagagggttaaataaggaaagaagatgattgaacaatttttcaggcccgactctgtcgaacaggcgctggaactgaagcgccgctaccaggatgaagccgtctggttcgccgggggcagcaaactcaatgctacaccaacccgtaccgataaaaagattgccatttccttacaggatctggaactggactgggttgactgggataacggtgcactgcggattggcgcaatgtctcgcttgcagccactgcgtgatgcgcgatttattcctgcagcgctgcgtgaagccctcggttttgtttactcacgccatgttcgtaatcagtcgaccattggtggtgaaatcgccgcccgccaggaagagtcggtgctgcttcccgtcctgttggcactggatgctgaactggtttttggcaacggcgaaacgctgtcaatcgaggactacctggcctgcccatgcgatcgcctgctaaccgaaattatcattaaagatccgtatcgcacctgtgcgacccgcaaaattagccgttctcaggcaggtttaaccgtcgtgacggcagccgttgcaatgacagaccacgacggtatgcgaattgcgctggatggcgtcgccagtaaagcactgcgtctgcatgatgtcgaaaaacaaaatctggaaggcaatgcacttgaacaggctgtcgccaacgccattttcccgcaggaagatttgcggggcagcgtggcctataaacgctatatcacgggagttctggtagccgacctgtatgccgactgccaacaggctggggaggaagccgtatgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaataatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgacctagaagtcattggtaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatctactataccccgggtggtcagagcgcaccggaaccgtcaccgcttgaccgccgtatgttcggcaagaaaatgcgtcacgtcggcgatcgtgttgctgcggtcgtcgcagaaagtgaagaaattgcgctcgaagcactgaagctcatcgacgttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgccagtattcatggtcatattggcgatatggacaaaggctttgccgatgccgatgtgatcattgagcgaacctataactcaacgcaagcgcagcagtgcccgactgaaacacatatctgctttactcgtatggacggcgatcgtctggttatccacgcctccacccaggtaccatggcacttacgccgccaggtcgcgcgcctcgtgggcatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgtgcactggaagagatcctgcgtcagggtcgcgagatgatccaatggtcgtcaccgaaaccgcaaaatggtgactggcacatcggtcgcggcgtcgccattatcatgcagaaatcgggtatcccggatatcgatcaggctaactgcatgatcaaactggaatcggacggcacctttatcgttcattctggcggtgcggatattggtactggtctggatactgtagtgacgaaactggcagcagaagtgctgcactgcccaccgcaggacgtgcatgttatctccggtgataccgatcatgcgttgtttgataaaggcgcatatgcctcgtccggtacttgcttctcgggtaacgcggcgcgtttggcagcggaaaatctacgggagaaaattctgttccacggcgcgcaaatgttgggtgagccagtggcagatgttcaactggcaacgccgggcgtcgtgcgcggcaagaaaggcgaagttagtttcggggatattgcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccgttcggggcgaaatcgatctcggaaatcggtgtaaatggcgcagctccggcgattgctaccgcaattcacgatgcatgcggcatctggttacgcgaatggcatttcacaccggagaaaatactcactgcgctggaaaaaatataaataataaatggccgcttcggcggcctgtttctctgtttgaacgatgactaaatagtgactgcgaaaatgagataagccgttctcaaggcgtcctgcgccccaaattcgtgggaatttattttactaattcagatgatcaaatttactttaaaaggagtgaagggatgtctgatataaaccatgcaggttctgaccttatatttgaactggaggatcgccctccctttcatcaggctctcgttggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggcctactctcaattcagtcagtcaatttttcatttgttacggtcatgattgcgctgggcagcagcatgaaaagcgacggttttcacgaagagttaatcatgtcgtcgcttctcggcgtctccttcgttggcgcatttctggttgtcggatcttcatttatcttgccctatttacgtcgggttattacgcctaccgtcagcggtattgtggtactgatgatcggcttaagcctgattaaagtcggcattatcgattttggtggaggatttgcagccaaaagcagcggtacgttcggcaattacgaacatctcggcgttggtttattggttttaattgtggtgatcggctttaactgctgtcgcagtccgttgctacgcatgggagggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagcagtcggcgatatcaccgccacggcaatggtttcccgccgccccattcagggggaagagtatcagtcccggctgaaaggcggcgtgctggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttcttcacgaccattccctcggcagttctgggaggcgcaatgacgttgatgttttccatgattgccatcgcagggattcgcatcatcatcaccaacggtttaaagcgccgtgaaacacttattgtcgccacttctttaggtttagggcttggcgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaacagtaaaggagtcaatgatgtcaggagaacacacgttaaaagcggtacgaggcagttttattgatgtcacccgtacgatcgataacccggaagagattgcctctgcgctgcggtttattgaggatggtttattactcattaaacagggaaaagtggaatggtttggcgaatgggaaaacggaaagcatcaaattcctgacaccattcgcgtgcgcgactatcgcggcaaactgatagtaccgggctttgtcgatacacatatccattatccgcaaagtgaaatggtgggggcctatggtgagcaattgctggagtggttgaataaacacaccttccctactgaacgtcgttatgaggatttagagtacgcccgcgaaatgtcggcgttcttcatcaagcagcttttacgtaacggaaccaccacggcgctggtgtttggcactgttcatccgcaatctgttgatgcgctgtttgaagccgccagtcatatcaatatgcgtatgattgccggtaaggtgatgatggaccgcaacgcaccggattatctgctcgacactgccgaaagcagctatcaccaaagcaaagaactgatcgaacgctggcacaaaaatggtcgtctgctatatgcgattacgccacgcttcgccccgacctcatctcctgaacagatggcgatggcgcaacgcctgaaagaagaatatccggatacgtgggtacatacccatctctgtgaaaacaaagatgaaattgcctgggtgaaatcgctttatcctgaccatgatggttatctggatgtttaccatcagtacggcctgaccggtaaaaactgtgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagttaaagtgggcatgggaacggatatcggtgccggaaccactttcaacatgctgcaaacgctgaacgaagcctacaaagtattgcaattacaaggctatcgcctctcggcatatgaagcgttttacctggccacgctcggcggagcgaaatctctgggccttgacgatttgattggcaactttttacctggcaaagaggctgatttcgtggtgatggaacccaccgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaataataaaactttaacatcctcgtgaggacatcattatgtctggagacatcctacaaacaccggacgcaccaaagccacagggcgcgctggataattattttaaaattaccgctcgtggcagtaccgttcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatgggattatgggctaatttgccaatggcgattggttgcgcgatttccttgacggcgtttaccgcattcagtctggtactcgggcaacaaattagcgttcctgtcgcactgggcgcggtatttctgatgggcgtcatcttcaccgccatttccgtaaccggtgtgcgtacctggatcttacgtaatttgccgatgggtatcgctcacggtacaggtatcggtatcgggctgtttctgctgctgattgctgctaacggtgtgggtatggttatcaaaaacccgattgaaggcttgccagtggcgctcggtgcgtttacctccttcccggtgatgatgagcttgctggggctggcggtcatcttcggcctggagaagtgtcgcgtacccggcgggatcttgttggtgattattgcaatttcgatcatcggcttaatctttgacccagcggtgaaataccacggtctggtggcgatgccaagcctgactggcgaagatggtaagtctctgattttcagcctcgatattatgggtgcactccagccaactgtacttccgagtgtactggcattggtgatgaccgcagtgttcgacgctactggcaccatccgtgccgtcgccggtcaggcgaatttgttggataaagacaaccagatcatcaacggcggcaaagccctgaccagtgactcagtaagttcaatattctccggcctggtgggcgcagcgcccgcagcggtttatatcgaatcagcggcaggaaccgccgccgggggtaaaacaggtttaaccgcaaccgtagtgggggcgttattcctgttaattctgtttttatcaccgctgtcatttttgatccctggttacgccactgcacccgctctgatgtacgtaggtttgctgatgttaagtaacgtctcgaagctggatttcaatgattttattgacgctatggctggcctggtgtgtgccgtgttcatcgttctgacttgtaatatcgttaccggtattatgctgggctttgtgacactggtcgtaggccgcgtctttgcacgcgaatggcaaaagctgaatattggtacggtgatcattactgccgcactggtcgcattttacgcgggtggttgggcaatctaatagattctccgcgcctttcagcgcggagatttctttcagagaggattctcaccgctggcaacaatacgctgctggcggactcgcctgagttctctttcagtaagcaactgcagcgcctgtgttgggcaagattcaacgcaggctggcccctcttcccgctgttcacagagatcgcatttcacaatttgttgtcgggtatcccccggcaacgactgaatggtgatcattccaaacgggcacgcactgacgcaactctgacagccaatacaacgggcagaattggtctgcaccacctgctcgcccatcgtcagcgcccccacggggcaagcgccaacacaaggggcgttttcacactgatggcacatcaccggcgcactgatgctgtccagtcgctgtaccttcagccggggtaaaaagacatcggcattcaactcctgttctgaagggtgagcgaccacacaggctacttcacaagtacggcagccaatacagtcagccggattaacgataattaacgatttcatcacgatgccttcgtatcaaacagagttaacatatcgcgcgccgcctgccttcctgcggccattgcagtgacaaccagatccgcgccatgaactgcatcaccaccagcaaagacttttttcagatgcgtctgggtaggtaaatacccgacgtcaccggtttgaatcaggccccatttatcgagtttaattccgctgccctgcaaccacggcatggcatgcgcctggaaaccaaaggccataatcagaacatcggcgggcaattcaaactctgaacccgctaccggacgaggacgacggcgaccatccggccccggctcacccatggcggtacgaatcaggcccaccgcagttaaacgcccatcttcgtcacaagcgatatattgcggttgaacattgaactgaaactcgacaccttcctcgcgcgcattaaccacctctttgcgcgagcccggcatactgacttcatcacgacgatacgcgcaggtcacgctggcggcattgaggcggatggaagtccgcaaacaatccattgtcgtatcgccaccgcccaataccacgactcgcttaccttccacgtccgtcagcggatactcttcagactccggcaatcccatgagctggcgggtatgggcagtcaggaacggtagagcctgaatgacaccgggcgcatcttcatgcggcagatctgctcgcatcatcccgtaagtccccacgccgatgaaaactgcatcatattcagaagttaaatcgctaaaggtaatatcgcggccaatttcacagttaagatgaaagtcgattcccattgcggtgaatatctctcgccgctggcttaataccgttttatcgagtttgaaaggaggaatgccaaaagtcagcataccgccaatttctggatggcgatcaaagacatcgacctgaactcctgcgcgcgccagaatatcagcacaccctaaccctgcaggcccagcgccaatcaccgccactttttcgctacggggaacaactttgctgacatcgggacgccagcccatcgccagcgcggtatcggtgatgtagcgttccagattaccgatagagactgcgcccgagtgatctttcaaagtacatgcgccttcacaaagacggtcctgtggacataccctgccgcaaatttctggtaaggaactggtctggtggcaaagttctgccgcttcaataatctttccttcctgtaccagacggatgtaatccggaatagcgttatgcagcgggcaatgccagttgcagttagctttttcggcacaataaacacagcggtcactctcataagtcgcttgttgtggatccagcccgcaatatatttcgccaaagtgggttttccgttcactcgctgaaattttatctgcgcctttacgcgagttaacggggagcaacgctgcactgcgagatggctgagcgtctgatgacgcttttcctgctgccgttttgcgctggcgggccacctttatctgctgcaaccctttatcgtccatcagtcgtaacgcctgtgttgggcaaacttcaatacaggcttgcgtgccggaactgcgctggttacaaaggtcgcatttctgcgcaatcgtatcgaccatctcaacgacgccaaaggggcaagcgattgcgcatcttttacaaccaatacatttttgctcgtccagttgtacgctatcggactggaaagtcagagcattaaccggacaagccgtaacgcaaggggcattgttgcagtgatggcaggccaccggattcgcagcctggcctttccctacaacgtggatacgcggtcgaaagtcactgtgactcagcggccagttttcttgattgtgtgccaccgcacaggcaatttcacaagcatgacagcctatacattccgcagcttcagcagcaataaacttattcatttgcatccctttcatttaatgagttatgtcttctcaaatttcgcgatgcaataaacgggcatatattaggtagcatgaccgttttaattataattttgcgactgagttcaaattattgcccctcaatctatgccgctttcattatttcaacattgccgatcaaaagagcgctatccagataaaaacgattaaatgcgagagtgcgacatgccagaatgattaatgaaatatcaatatgagaaaattacagataattccattgtcaggttctcttctcattttcgtggtttaaccacgattatgtgattgcctccgcaattcctgtctctaactccccttcctcgcaaaaactggcactccacgagcatgtgtttagacagtttcattaacgtaaacggttgctttttactctggcgggcgaaaggagaaacactgatgagcgccatagattcccaacttccctcatcttctgggcaagaccgcccaactgatgaggttgaccgcatattatcaccaggaaagctgatcatactcggtctgcaacacgtccttgtcatgtacgcaggtgcagtcgctgttcctcttatgattggtgaccgactgggcctctcaaaagaagctattgcgatgctcattagctcggatctcttttgctgcgggatcgtcacattattgcaatgtatcggtatcggccgctttatggggatccgcctgccggtgattatgtcggtgacctttgctgctgtaacaccaatgatagccattgggatgaacccggatatcggcctgctggggatatttggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggctttttactttcgtggatgatgaatgaagtcaatttatccgggctacatgatgcttcatggtttgcgattgttacgccgatgtcgtttggtatgccgattttcgatcccgtttccattctgaccatgactgccgtgttaatcatcgtgtttatcgagtcaatggggatgttcctggcactgggtgaaatagtcggtcgtaaactctcttcgcacgatattattcgcgggctgcgtgtcgatggcgtagggacaatgataggcggcacgtttaacagcttcccccacacgtcattttctcaaaacgttggcctggttagcgtgacgcgcgttcatagccgctgggtgtgtatttcttcgggaattatattaatcctgtttggcatggtgccaaaaatggcggtgctggtagcctccattccgcaatttgtgctgggcggcgctggtctagtgatgttcggcatggtactggcgacagggattcgaattctgtcgcgctgtaactacaccaccaaccgttacaacctctatattgtggcgatcagtctcggcgttggcatgactccgacgctctctcacgatttcttttctaagttaccggccgtactgcaaccgctgctacatagcggcattatgctcgcaacccttagcgccgttgtgctgaacgtcttctttaatggctatcagcatcatgctgacctggtgaaggaatccgtctctgataaagatttaaaagtcaggacagtacgtatgtggcttctgatgcgcaagctgaagaaaaatgagcatggagaataatatgaattttttaatgcgcgctatattcagtctgttgttgctttttactctctctattcctgtcatttctgactgtgttgcaatggccattgaaagtcgcttcaaatatatgatgctacttttttaaatggtttttacctgtcggcatccgctcaaaacgggcggttgtcgataaacgctcacttggttaatcatttcactcttcaattatctataatgatgagtgatcagaattacatgtgagaaattatgcaaacggaacacgtcattttattgaatgcacagggagttcccacgggtacgctggaaaagtatgccgcacacacggcagacacccgcttacatctcgcgttctccagttggctgtttaatgccaaaggacaattattagttacccgccgcgcactgagcaaaaaagcatggcctggcgtgtggactaactcggtttgtgggcacccacaactgggagaaagcaacgaagacgcagtgatccgccgttgccgttatgagcttggcgtggaaattacgcctcctgaatctatctatcctgactttcgctaccgcgccaccgatccgagtggcattgtggaaaatgaagtgtgtccggtatttgccgcacgcaccactagtgcgttacagatcaatgatgatgaagtgatggattatcaatggtgtgatttagcagatgtattacacggtattgatgccacgccgtgggcgttcagtccgtggatggtgatgcaggcgacaaatcgcgaagccagaaaacgattatctgcatttacccagcttaaataaaaaaaccccgacatttgccggggttgtgagcataacgtaatgcttattttaccggacgcatcgccgggaacagaataacgtcgcggatggtatggctgttggtgaacagcattaccatacggtcgataccaattcccagacctgctgtcggcggtaagccatgttccagtgcggtgacgtaatcttcatcgtagaacatcgcttcgtcgtcacctgcgtctttcgcggcaacctgatccaggaagcgttgcgcctgatcttccgcgtcattcagctcgctaaagccgttaccgatttcacgaccaccaatgaagaactcaaagcggtctgtgatttccgggttaacgtcgttacgacgcgccagcggagaaacttctgccggatattcagtaatgaaggtcggctgaatcagatgtgcttctgccacttcttcgaagatctcggtaacgatacggcccagaccccagctcttctcaacgtggatgccgatagattcagcaattgctttcgcagagtcgaagttgtccagatccgccatgtcggtttccgggcgatatttcttgatcgcttcacgcatggtcagtttttcgaacggtttaccgaagtccagcgtcacgtcgccgtaggtcacttccgtcttaccgagaatatcctgtgccagagtacggaacagcgattcggtcagctcgatcagatctttgtaatctgcgtaagccatgtagagttccatcatggtgaactctgggttatgacgtacggaaataccttcgttacggaagttacggttgatttcgaatacacgctcgaagccaccaaccaccagacgcttgaggtacagttccggcgcgatacgcaggtacatgtcgagatccagcgcgttatggtgggtgataaacggacgcgcagcggcaccgccagggatcacctgcatcatcggcgtttcaacttccataaagccgcggttcaccatgaactggcgaataccagagaggatctgcgagcgcactttaaaggtgttgcgggattcatcgttggagatgagatcgagataacgctgacgatagcgcgcttcctgatcctgcaagccgtggaatttatccggcagcggacgcagtgctttggtcagcagacgcaactcggtgcagtggatagacagttcgccggttttggttttgaacagcttacctttcgcgccgaggatgtcgccgaggtcccattttttgaactgctcgttataaacgccttccgggagatcgtcacgggcaacgtacagctgaatgcgaccgccaacgtcctgcagggtaacgaaagacgctttacccataatacgacgggtcatcatgcggccagcaacggcgacttcgatgttcagcgcttccagttcttcgttctctttgccgtcgaattctgcgtgcaattggtcagaggtatgatcgcgacggaaatcgttcgggaaggcaatcccctgctcgcgcaggttcgccagcttctcacgacgcgttttcagttcattgttaagatcgactaccgcgtcagcgccctgtgcgtgttgttcagacatgttggttcctcataaccctgctttcaaacttgcttcgataaattgatccaggctgccgtccagcacggcctgcgtgttgcgggtttctaccccggtgcgcagatctttaatgcgggagtcatcaaggacataagaacgaatctggctgccccagccgatgtcggatttgttatcttccatcgcctgtttctcggcatttttcttctgcatctccagttcataaagcttcgctttcatctgcttcatggcctgatctttgttcttgtgctgggaacggtcgttctggcactgggtcacgatcccggtcgggatgtgggtaatacgcaccgcagattcggtacggttaacgtgctgaccgcccgcgccggacgtgcgataaacgtcaatgcgcagatccgccgggttgatttcgatatcaatatcatcatcaacttccggataaacaaacgcggagctgaacgacgtgtggcgacgaccgccggagtcaaacgggcttttacgcaccaggcggtgaacgccggtttctgtacgcagccagccgtaagcgtaatcgccggagattttgatcgtcacggatttaatacccgccacttcaccttccgactcttcgatgatttcagttttgaaaccacgcgattctgcccagcgcagatacatacgctcaagcatgctcgcccagtcctgtgcttccgtaccgccagaccccgcctgaatatcgaggtagcagtcggcgctgtcatattcgccagagaacatacggcggaactcaagctgcgccagtttttcttccagggcgtcgagttcagcaacggcttcgttaaaggtttcttcgtcgtcagcttctacagccagttccagcagaccagaaacatcttccagcccctgtttcatttggtcgagggtgtcgacaacggcttcgagggaggaacgctctttacccagcgcctgtgcgcgttcgggttcgttccagacatccggctgttccagctcggcgtttacttcttccagacgctctttcttggcgtcgtagtcaaagataccccctaagaacgtcggagcgttccgtgaggtcctgaatgcgattatttaccggattaatttcaaacatggtctgatttcttttattgagctagtcaaaatgcggtgataagagcgggattgtacccaatccacgctcttttttatagagaagatgacgctaaattggccagatattgtcgatgataatttgcaggctgcggttgccgcgaaactcgttgatatcgagcttataagccagttgcacttcgcgcacgccgttatccggccagagggcggtatcgacattaaaagcaataccatccagcagtggaccgccgccgaccggttcgaccatcaccttcaaatgacgttcgcccaccagccgctgttgcagcagacggaaatgaccgtcaaacagcggctccgggaacatctgcccccacgggccagcatcgcgcagcagctgcgccacttccatggtcatttcggccgggcttaacggaccgtctgataccacttcgccttgcaatagcgaagggtccagccactcagtaaccagttcgccaaaccgttgttgaaagagtttgaatttatcctcttccagcgacaaacccgccgccatcgcatgaccgccaaacttcagcatcatgccagggtagagtgtgtctaatcgctccagcgcatcacgcatatgcagcccctgaatggagcgaccggaacctttcagcgtaccgtcacctgctggcgcaaacgcgataaccggacggtgaaaacgctctttgatgcgcgaagccagaataccgacaacgccctgatgccattcggggtgatacattgccagcccgccgggtagcgtgtcacggctgcgctccagtttctcgcacagggtcagggcttcaatttgcattccttgttcgatctcttttcgcgtctggtttagcgcatcgagttcatttgccagcacgcgcgcttcgccgatgttgtcgcacaacaacagcgccacaccgacggacatatcgtccagtcgtccggcagcattgagacgtggccccagcgcaaaacctaaatcgctggcggcgagtttttgtgcatcacggtttgccacttcaagcagcgctttaatccccggacggcactttccggctcggatgcgactcatcccctgccaggtcagaatgcgattattagcgtccagcggcacgacgtccgccactgtccccagcgcgaccagatccagcagttctgccaggttaggaattgcgatgttacgctcatcaaaccagccctgatcgcgcaaaaaggtgcgcagcgccagcatcagataaaacgccacacccacgcctgccagtgatttcgacgggaaattacagtcgcgcaagttagggttaatgatcgcttccgctgcgggtaatgtgtcgcctggcaaatggtgatcggtaacaataaccgggatgcccaacgagcgagcgtgctcaacccccgcatgggaggaaataccgttatccaccgtgacaattaactgcgcgccacgggcatgggcctgatcgaccacttccgggcttaagccgtaaccgtcttcgaaacggtttggtaccaggtagtcgatattgctgcaaccaagcgagcgcatcgccagcacgcttagagccgtgctggtcgcgccgtcggcgtcgaaatcaccgaccacaataatccgcgttccttcgcgaaaagcgttgtaaaggatctcaacggccttttcgacgccgctcagttgctgccagggcagcatacctttaacactgcgttccagttcttgcgcactgcgtactccccggctggcgtataaacggcgcagcaagggaggcaattcagcgggcaagtctgccgtttcatcgacttcacggcgacgaagttgtatctgttgtttcacgcgaattatttaccgctggtcattttttggtgttcgtcgaggaattctttcatctctttcggcggctggtaacccggaacaagtgtgccattgctcagcacaactgccggagtaccgctaacgccaagctggacgccaagtgcgtaatggtcggcaatatccacgtcgcaactggctggtgcgacgcttttacctgccatcacatcatcaaacgctttgtttttatctttcgcacaccagatagctttcatttctttctctgcatcgctgtccagcccctggcgcgggaaagcaagataacgcacggtgatccccagcgcgttgtagtctgccatttgctcatgcagtttgtggcagtaaccacaggtaatatcagtaaacacggtgatgacgtgtttttcctgcggcgctttataaacgatcatctctttttcaagcgcattcaactgctttaacagcatcttattggtgacattgaccggagccgtgccactaacgtcatacattggcccctgaatgatatgtttaccatcatcggtgatgtacaacacgccgctgttagtcagaactgtcttcatgccagctacaggcgcgggctgaatatcgctgcttttgatgcccattttggctaacgtttgttgaattgccgcgtcatcagcctgagcaaagcctgaaaacgccgctaacaaagtaaacaacataaaacctttcttcataaatcttcccgttcttttcagacatcacgcccgcgggtgatgctgttgatgaagttgccgcagacgctcggtagcgacatgcgtataaatttgcgtggtggagagatcgctgtggcccagtagcatctgcaccacgcgtaaatccgcaccatgatttaataaatgagtggcaaaagcgtgacgcaacacatgcggtgacagcttttcgctgtcgatacccgccagcacagcataatgtttaatacggtgccagaaggtctgtcgcgtcatctgctgcgcacgctggctgggaaacaacacgtcaattgacacaccattcagcagccacggacgcccatgttccagataggtttccagccagtaaaccgcctcttcacctaacggcaccagacgctctttgttgcctttaccaatgacccgtaccacgccctgacgcaggctgatatcactcattgtcagtccgaccagttcagagacacgcagcccggtagcatacaacacttcaagcatggctttatcgcgtagctccagtggctgatcgattaatggtgcctgtaataaacgttcgacctgcgcttcgcttaaatcttttggcaaacgctggggcaatttcggtgaagcgagatgcgcactgggatcgtcttcacgaaacttttcgcgataaagatactggaacaatcggcgcactgcactcagcaaacgcgctgagctggtggctttatacccgccctccagccgttctgccagtaatgcctgcaaatcgtcactttgcgccgtcgccagcgtcaacccgcggtgatgcaaccactccaccatcattgacagatcgcgacggtaagcgttcaacgtattttcagccagatttttttccagccacagagcatcaagaaactgctcgatgcgtgccagatcctgtttcacttgcgccccttatggtcactcatttgatccattatgccttattgtgccgtgactaaagcgattctgatacactagccgcaaaagccacagcagaatcgagaagcttacgttatgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggtgaaatccaggaagactgggaagccgtctgggatcagctcgacgacctgaaccttgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcagagctggtgcgagcaaatcctcaacgaaatggcagagcattacgcctgatctcactgacggcttagcgcatatgctttgccgtcatctttatctttgcgtctcttgttgcaacaaaatccgccgtaaatcccgccattcagcttcgtccatgctgtcggctgccagccataaatgttgccgtttaccgccatcagaacgtaaacgcagcatcatgccgctcttaatcatccacggtgctttgacgatgctccactcctgcccttgccaacgcaaacgcccgtccatcaacaagcgaatttccccctggcgagcattaatacgccgctggctgcgaacgcaatcaaacaccaccagcgaaagtaacaccatccataacggggtgtaactgagtggccagggcatgagtaaaataacagcggcaaccagcccatgaatcagcaaggaaagccactgtgcgcgccaggagacgcgcaaatcagattgccacaggaccacgttcccggttccgtgtctggatgagtcggaccatcatttccagttctgcatcggccggtttaccgtgattcatcagccagttaaacaggtccggatcgtcacattccagcagacgaataaagatgcgtttttcgtcatcgcttaagctgtcgtactcatgttcgaaaaacggcatgattgaaatatcgagttcgcgcataccacggcggcatgcccaatgaatgcgggctttgttgttaatgtccatcttcttcctgtctcacgaaaatccagtacccggctattgtaacgtgtttttcgccttcttttacgggaatatcagtaaacaccatcgcgatcgcgaaattaattcacaacaattcaatggcttcatttttttggaagtcgcctcgcagaaggcacagatcgcgtagtgaaagcacttgcattgcctcatagctcttttaccattagtcattaatacgccgttaagcaactcaggactctattatggcttttacaccttttcctccccgtcagcctacggcttctgcccgtttaccgctgacgctgatgacgcttgatgactgggcgcttgccaccattactggcgcggacagcgaaaaatatatgcagggtcaggtgacagcagatgtcagccagatggcagaagatcagcacctgctcgccgcccattgcgacgccaaaggtaaaatgtggagcaatttacgtctgttccgcgacggcgatggctttgcatggattgaacggcgcagcgtgcgtgaaccgcagctgactgaactgaaaaaatatgcggtattctctaaagtgaccatcgcgccagacgacgagcgtgtgctgcttggtgttgccggttttcaggcgcgcgccgcgctggcaaatctctttagcgaactgccttcgaaagaaaaacaggtagtcaaagaaggcgcgaccactttgctatggtttgaacacccggcagaacgtttcctgatcgtaaccgatgaagctactgctaatatgctgaccgataaactgcgcggtgaagcggaactgaacaatagccaacagtggctggcattaaacattgaagcgggtttcccggtgattgatgccgccaacagcgggcagtttatcccacaggcgaccaatctccaggcgctgggcggtatcagctttaagaaaggctgttataccggacaagagatggtggcgcgagcaaaattccgtggtgccaataaacgtgcgctctggttgctggcaggtagcgccagccgactgccggaagctggtgaagacttagagctgaaaatgggcgagaactggcgtcgtaccggtacggtactggctgcggtaaaactggaagatggtcaggtcgtggtacaggtcgtcatgaataacgatatggaaccggatagcatcttccgcgtacgcgacgatgcgaatacattgcatatcgagccgctgccgtattcgctcgaagagtaaatctctttatcgcatcaggcatttatcgcctgatgcgacgctggcgcgtcttatcatgtctgggatttgatgcctttatcacaacagggacgaggcccgtagatcggataaggcgttcacgccgaatccggcagttgtgctccgatgcctgatgcgacgctggcgcgtcttatcaggcctacaaaggcatacccattacgcctgcccaatatacaaatagatcgccagaaagtggcacacactaccgccgagcacgaagccgtgccagatggcatggttgtatggaatgcgtttgcagacgtagaaaatcaccccgagcgaataaaccacgccgcctaccgccagtaaggtaacgctgcccgccgcgagcttaactgccatttcataaattaccaccagcgacagccagcccatcgccagataggtcaccagagataaaattttgaatcggtgcgcgatggtcagtttaaacagaatacccagcaatgccaggctccagataacaatcatcaacccgcgcgctaacggagaatccagccccaccagcaaaaacggcgtgtaggttccggcaatcaacaggtaaatagcgcaatggtcaaatttcttcagccacatttttgcccgttgatgaggaatggcgtgatagagcgtcgaagcgaggaacagcaggatcatactgccgccatagaggctgtagctggttatcgctgtggcgctggcattaagatccaccgcctgaaccagtagcaacaccagcccaacgataccaaacaccaacccaatgccgtgactgacgctgttggctatttcctctgccagtgaatatccctgcttaatgaggggcttctgaaccataacttactccggagaaacgtacacgcacatgtatacctctccagcgtaactgagaatagttccagtgaacacctgttagctaaaataaattctgatttgagactaatctcctaaaaatcatgaaattaaatgcgaaatttcaactaacaggcgtgagttcaatttaaagacatttaaattcaatcacataaaattgtgtctgaccgggatagatgtcagcaatgacttttttcagttcagtcagggtcatattttcctgctctgcatgtttttcagtcagcgtatccagcgttacggttgaggttgcggtgacttcaatcgtgcaaaaataaccgtcatcttcaaaacgtccgacacgaagcacatcacccgttttgaagtgcgattcagactcgtcgcggatggtgatggttttacgcccagccagaatgtcatcctggaaacgttgaaaaaaagtgatgtcgtttggctgcatggtactatttcctgtaagaattgactcatctggagcctatgatagtgaaaaaactcaccttaccgaaagatttcttatggggcggcgcagttgccgctcatcaggtcgaaggcggctggaacaaaggcggaaaagggccgagcatttgtgacgttctgaccggtggcgcacacggcgtgccgcgcgaaatcaccaaagaagtcttgccaggaaaatactatccaaaccatgaagccgttgatttttatggtcactataaggaagacatcaagctatttgccgaaatgggcttcaaatgttttcgtacatccattgcctggacgcgcatttttccaaaaggcgatgaagctcagccaaacgaagaagggctgaagttctacgatgatatgttcgatgaactgctgaaatacaacatcgaaccggtgatcaccctctcccactttgaaatgccgctgcatctggtgcagcaatacggtagctggaccaaccgtaaagtggttgatttctttgtacgtttcgcggaagtggtatttgaacgctataagcacaaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagctgcgcgtcgcattaacccggagatgaaagtcggctgtatgctggcgatggtgccgctctatccttactcctgtaacccggacgatgtgatgttcgctcaggagtcgatgcgcgaacgctacgtctttaccgatgtgcagctacgcggctattacccgtcctatgtgttgaacgagtgggagcgtcgcggatttaacatcaaaatggaagacggcgatctggatgtgctgcgtgaaggcacctgcgattatcttggtttcagctattacatgaccaatgcagtgaaggccgaaggcggcaccggcgatgcgatctctggttttgaaggcagcgtaccaaacccgtatgttaaagcatctgactggggctggcagattgatccagtaggtctgcgctatgcactttgcgaactgtatgagcgttatcagaggccgctgtttattgtcgaaaacggttttggcgcttacgacaaagtggaagaagatggcagcatcaacgacgactaccgcattgactacctgcgcgcccatatcgaagagatgaaaaaagcggtgacttacgatggcgtggatctgatgggctacacaccgtggggctgcatcgactgcgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaagctttaagtcgatgaagtaccggatgcaatacttgttgcatccggtcagacaacttccctgttttatttcccgcccgccaaatcgataaaacttcccgtgacgtaagaggctttatcacttagtagccagacaatggcctgcgcgacctcttctgcctgtccaccacgctgcatggggatgttcgacttaacgcgatcgacgcgtccaggctcgccgccgctggcgtgcatttcggtataaataaaccctggccgcacgcagttaacgcggatcccctgcgcggcgacttccagcgatagtccggtggttaacgtatcaatcgcccctttcgatgccgcgtaatcaacatattcccctggcgaacccaaccgtgaggccaccgaagagacattgacgatagcgccgccactgccaccatttttaagcgccatgcgttttaccgcctcgcggcagcagagaaaatatcccgtcacgttggtggaaagtactcggttgattcgctctgcggtaaggttttcaacggtgcactgggtaaacaagatcccggcgttattgaccagcgctgctagcggttcatcgtgctgatcgattgctgtaaacatcgcaacgacctggttttcgtcgctgatatccgcctggagcacgaatgctttgccaccggcttgcgttattaagttcatcacttcctgcgccgcgtggaggttttgctgataattaaccgccaccgtatacccttcttgcgccaacagtaatgcagttgcccgcccgatgccgcgactgccaccagtcacaagtgctatagccatttgtttttccgagaaaaattaattcgttgacgtatctttgagattgctaacaaactggctcaatcttcaatgttggcacgcttttccccctcgccctttcagggagagggccggggtgagggtaaatattcgcgccagtgccggcctgttcccctcaccctaaccctctccccaaaggggcgaggggactgtctgagcacttttgtactttgtcatctgactaaaaaggcgccgaagcgcctttagaaaatagtcgaatcagtgaattactggtattcgctaatcggtacgcaggagcagaacaggttacggtcgccgtaaacatcatccagacgtttcactgtcggccagtatttgtctgccacacctgccgggaataccgcaacttcacggctgtacggatgcgcccactcggcgaccagttcgctctgaatgtgcggcgcgttcaccagcgggttatcttccagcggccagacaccggctttcacctggtcaatttctgcgcggatagccagcatcgcgtcgataaagcgatccagttccactttgctttcagattcagtcggttcaaccatcagcgtacccgccaccgggaacgacatcgtcggcgcgtggaaaccgtagtcgatcaggcgcttggcaatatccagctcgctgatgccggtttcttctttcagcgggcgaatatcgagaatacattcgtgcgccacgcgaccgtcgcgaccggtatacagcaccgggaaggcatcctgcaggcggctggcaatatagttggcgttgaggattgccacctggcttgcttttttcagcccttctgcgcccatcatgcggatgtacatccagctgattggcaggatagaggcgctaccgaacggtgccgcagaaaccgcgccctgacgggttaacatgccttcgatttgcaccacgctatgacccggtacaaacggtgccaaatgcgctttcacgccgatcggtcccatacccggaccaccaccgccgtgcggaatgcagaaagttttatgtaggttaaggtgtgaaacgtccgcaccaataaagcccggcgaggtgatgccaacctgggcgttcatgttcgcgccatcaaggtaaacctgaccgccgaactgatgcacgacttcacacacttcacggatcgtttcttcatacacgccgtgggtagaaggataagtcaccatgatacaggagaggttatcgcccgcctgttccgctttcgcgcgcagatcagtcagatcgatgttgccgtttttatcacacgccacaaccaccacctgcattcctgccatatgtgcagaagcggggttagttccgtgcgcagaagccgggatcaggcagatatcgcgatgcccttcgttgcggctttcatgataatgacgaatcgccagcaggcccgcgtattcgccctgtgcgccagagttcggctgcatacaaacggcgtcgtaaccggtcagtttcaccagccagtcagccagctgcgcaatcatctgctgataaccttcggcctgctccggcgggcagaacgggtgcagttcggcaaattccggccaggtgattgggatcatctcggcggcggcgttcagtttcatggtgcaggaacccagcgggatcatcgcctgattcagcgccagatctttacgctccagcgagtgcatatagcgcatcatttcggtttcgctgtggtagcgattaaacaccggatgggtgaggatttcgtcgtcgcgcagcatcgcaggctggatagagcggctgtcgtgagccacgtctttgtccagcgtgtcgatgtccaggccgtggttatcgcccagcagcacgttgaaaagctgcattacgttttcacgcgtggttgtttcatcaagggtgatcccaaccgcgttcagaatatcgctacgcaggttgatttcagccgcttcggcacgcgtcagtacgcccgctttgtcggccacttccacacacaaggtgtcgaaatagtgcgcatggcgcagtttcagacctttttgttgcaggcccgccgccaggatatcggtcagacggtgaatgcggttagcgatacgtttcaggccaaccgggccgtgataaacggcatacaggctggcgatgtttgccagcagtacctgggaagtacaaatgttggagttcgctttctcacggcggatatgttgctcgcgagtctgcatcgccatgcgcagcgcggtattgccagctgcatctttcgatacaccgataatacggcccggcattgagcgtttgtattcatctttcgccgcaaagaatgccgcgtgtgggccaccgtagcccatcggcacgccgaagcgttgcgccgaaccaaaaacaatatccgcgccctgtttacccggcgcagttaacagcaccagcgccataatatcggcggcaacgctgaccacaattttgcgtgatttcagttcgctaataagcgcagtgtagtcgtgaatttcaccggtagtgcctacctgctgtaacagcacgccgaagacgtcctgatggtcgagcactttttgcgcgtcatcgacaatcacttcaaaaccaaaggtttcggcacgagtacggaccacatccagcgtttgcggatgcacatcggaagccacgaagaagcggttggcatttttcagtttgctgacgcgtttcgccatcgccattgcttcggcggcagcggtggcctcgtccagaagagaagcagaggccatatccagtccagtcaaatccagcgttacctgctggaagttgagcagtgcttcaaggcggccctgggagacttcaggttgatacggagtgtacgcggtataccagcccggattttccagcatgttacgcaggataaccggcggtagctgcacggcggtgtaacccatgccgatgtaagacgtgaagcgtttattgcgactggcaatagccttgagttctgccagtgcggcgtattcggtcgccggtgcgccaacctgcggtggtgtcgcaagttgaatatctttcggcacaatctggccggtcagcgcgtttaacgattgtgcaccaacggcattcagcatttcttgctgttgcgcggcgtccggtccgatatggcgttcaataaaagcgccgctgttttcaagctggcttaacgtctgtgtcatgagcgatggttcctgaaacgtgcagtgaattgtgaacctctctccttacgaagagagtgagggtgaggcataaattttcctcaccctgatcctctcccgcagaagaggaataaagccgttactcgtcttctaacaatgcttcgtatgcggtcgcatccagcagtgattccagttcgctttcatcgctggctttgattttaaagatccagccgcctgcatacggttcgctgttcaccagttccggggaatcgctcagtgcgtcgtttaccgccacgatttcaccgcttactggcgcataaatgtctgacgccgcttttaccgattcggcaaccgcgcagtcatcgcccgcgctaaccgttgcgcccacttccggcaggtcaacaaacaccatatcgcctaacagctcctgagcatgttcggtaataccaacggtgtaagtgccgtcggcttctttacgcagccattcgtgttctttgctgtatttcagttctgctggtacgttgctcatcaatcaatctccaaaaaagtaaatcacgcgacggctttgccgttacgcacaaaaacaggttttgtcactttaaccggcatttcacggttgcgaatttgcacaatcgccgtttcgccaataccttccggcacgcgcgccagcgcaatgctgtaacccagcgtcggggagaaagtaccgctggtgataatgccttcatgctggttgccctgcgcatcggtaaagcgtaccggcagttcattacgcagcacgcctttttcggtcatcaccagaccaaccagtttttctgtaccatgctcacgctgcacttccagggcttcacgaccgataaagtcacgatctgccggttcccaggcgatggtccagcccatgttggcggctaaaggagagatggtttcgtccatctcctgaccataaagattcatgcccgcttccagacgcagcgtgtcacgcgcgcccaagccacatggcttaacacccgcttccaccagcgcacgccagaaatcggccgctttttcattgggcagcgcaatttcatagcccgcttcaccggtataaccagtggtggcaataaacagatcgcccgcctgcacgccaaagaacggtttcatcccttccaccgcctgacgctgggcgtcattaaacagtgtggcagcttttgcctgcgcattcggcccttgcacggcaatcatggaaaggtcatcacgaacggtaatttcgatgccgaaaggttcagcgtgttgggtaatccaggagaggtctttttcgcgggtggcggagttaacaacgaggcggaagaaatcttcagtaaagtagtagacgatgaggtcatctatcacaccgccagaggcattcaacatccccgagtaaagggctttgccgcttttggtgagcttcgccacatcgttcgccagcagataacgcagaaactcccgggtgcggctgccgcgaagatcgacgatggtcatatgtgacacatcaaacattccggcatcggtacgtaccgcatgatgttcgtcgatttgcgaaccgtaatgcagcggcatcatccagccgtggaaatccaccatgcgagcgccgcaaagcgtgtgttgttcgtacaaaggagtctgttgtgccatcttgtcctcattgaataagcggggctgacaactttttcatggtgaaattatcaccacgaaacccagcatcggagccactcccggtccccaacgcaatcgttctcttttgcctgaacttaccaccgaaacagactgttaaccataaggtaaaattgatcatcacattagcttatggttaaaaaatgcaaaaatcgcgacagaataaaaaaccaaaaaatacaccagtttctatacaaagatgatgtgatgagaaagtcaatttgaataagacaatattaagagctaaaaaaatgtcaaaaaacactaaatcaaaaaataatggcattagaaaatataatgcgaaaacggaggtgaaattagtttatttcaaatgaggaaaatctcccggcgaaaaaaccgggagatgaaagtgtgatgggtatcaaataaacaacagaggagaaatttttaacgcagccattcaggcaaatcgtttaatcccattgcctggcggataagttgcggcttaacgccaggaagcgtgtcggccagtttcaaaccaatatcacgcagcagttttttcgccggattggtaccggaaaacagatcgcggaatccctgcataccagccagcatcaacgccgcactgtgcttgcggctacgctcatagcgacgcagataaatgtactgcccgatgtctttcccctgacgatgcaaccgtttcagttcggcaatcagctctgcagcatccataaagccgagatttaccccctgccccgccagcgggtgaatggtatgtgcggcgtcgcccaccagcgccagacggtgcgaggcaaactggcgcgcataacgccccgtcagtgggaacacctgacgcgcgctctcaaccttgcataagcccaggcgattatcaaaagcgatatttaacgcgcgattaaattcgtcttcacttgcctgctgcatccgctgcgcttcctctggcgacagtgaccagacaatcgagcaaagatgcggatcgctaagcggtaaaaaggccagaatgccttcgccatggaaaacctgccgcgccaccgcatcatgcggttcttccgtgcgaatggtcgctaccagcgcgtgatgctgataatcccagaaagtcagcggaatatcggctttgttgcgcaaccaggaattagcgccgtccgcgccaatcaccagacgcgccgttaacatgctgccatctttcagcgtcaggaaggtttcattttctccccaggcgacctgctgtaattctgcgggggctaacagagtgatatctgacgactgatgcgctttgttccacagcgcgtagtgaatcactgaattttcaacgatatgcccaagatggctatagcccatgctttgatcgtcaaacgaaatgtgaccaaagctgtctttgtcccacacttccataccgtgataacagctggccctacgagagagaatgtcctgccagacgccaagacgggtgagtaatttttcgctggcggcattgatagccgaaacgcgcagttgtggtggtgcattcgccgccagaggttcctgtacgcgctgctccagtacggcaacgcgtaagccgctcccctgtaagccacaggcaaccgccagccccaccatgccgccgccaacaatggctacatcaacactttgcattgtttattccttaaaaccgccttcaacgcgccacccaaccgagggtgcgctgcgccagcacatcgcgtgccggggtgaataattccatcgtcatcagcccgatgttgcgcccgacaaccagcggtgcccaacggttggcaaaaagatgtacaaggctgtccgtgacgccaatggttgcttcgcgatcgctctgtcgacgctgctgataacggcacaatacgccgtaatcccccatgtcttctccgcgctcctgcgcctgagtcagggtttccgcaagactcatcacatctcgcataccgaggttaaacccttgcccggcaatcgggtgcagagtttgcgccgcattgcccaccagcacggtacgatgggtaatagatctggcggcgtgggttaacgccagcggataagcactgcgtttaccagcgtgggtaattttcccaagtcgccagccaaaggccgactggagttcacggcaaaacttctcgtcactccacgacaacacctcttcgcgccgttccagtggatgacaccagaccagcgaacagcgtccgtcagacatcggcaacatcgccagcgggccatgttgcgtaaagcgttcaaaagcgcgcccttcatgcgcaacggaagtagcaacgttggcaatcacggccagttgttcgtaaggctcctgctgccagtcaacgccgcacgcggtggctaacgctgaatgggtgccatcagctgctaccagcacgcggcccgtcagcgtctcgccactctccagcgtcacttcaacgtgactctgagtacgggcaacgttagccacgcgatcagggcaatgcagcgttacgccaggtgctttacgcagcaatgcaaacagccgttgcccgacattgtgcaattcgacaacctgtcccagcgccgccagttggtaatcttctgcggcgagggtgacaaatccagcgtgaccacgatcgctgacatgcacggtggtgatggcagttgcgcaatccgccagagattgccagacgccgatgcgcgccagttgctgacaggtacccgccgccagcgctatcgctcgtccatcaaagcccggatgagcatgtgactctggcgcagtcgcttcaatcaaatgtaccggcagcgccccgtgacttaaccgggaaatagccagcgccagcgtcgcgcccgccatgccgccaccgacgatgattacgctcattgctttctcgcagcaaccatcaacgcttcgatttcttccggctttttcaccacgctggcggtgaggttttcgttaccggtttcggtaatcacaatgtcgtcttcaatacgaatgccgataccgcgatattgttctggcacttctgcatccggcgcaatatacagccctggctctacggtcagtaccatgcccggttccagaatgcgcgagcgatcctgaccataaacacccacgtcatggacatccagtcctaaccagtggctaaggccatgcataaagaaaggacgatgggcgttctgagcgatcagttcatcaacatcacctttcaggatgccgagttttaccaggccgctaaccatgatgcgcaccacttcaccagtgacttccagaatggaagttcccggacgatacaggcgcaggctggtttcgagagactccagcacaatgtcgtagatttcacgctgggcctgggtgaatttgccgttgaccgggaaggtgcgggtaatatcgccagcgtaacctttgtattcacaacccgcgtcaatcaacaccaggtcgccgtcgcgcatttcacactcgttttcggtgtagtgcagaatgcagccgttttcaccgctgccgacaatggtgttataggacggatagcgcgcaccgtggcggttaaattcgtggtgaatttcgccttccagatggtactcgaacattcccggacggcatttttccatcgcccgtgtatgtgccatggcggtgatttctcccgcgcggcggagtacggcaatctcttctggcgatttgaacaggcgcatttcatgaacaacaggacgccagtcgatcatcgttgccggtgcggtgagattttgccgcgaacctttacgcagtttttccagcgcactgttcacgattacatcagcatatgcatattcgccctgggcatggtaaaccacatccaggccgttaagtagttgataaagttgctgattgatttcgctgaatgccagtgcgcggtcaacgcccagtttctctggcgcggcatcctggcctaagcgacggccaaaccagatctccgccgtcaggtcgcgaacgcggttaaacagaacgctgtggttatgagtgtcatcgcttttaatcagcaccagcaccgcttccggttcgttaaagccggtgaagtaccagaagtcactgttctgacgataggggtattcgctgtcggcgctacgtgttacttctggtgcagcaaaaatcagcgcggcgctgccgggttgcatttgctccaccagggcctgacggcgacgctgaaactcttgccgggatatctcactcataacactctccttacgttttttgtttttagtgtagagtcggtttttgtacttctggcgcggtcggttgcggatgagtaaaggtgtcgtggcataacagcgcggcaacacgaacgtattcgatgatctcttcaagcgacatttcaagctcttcctgatcttcgtcttcgtcgtaacccagttgcgcaatgttacgcagatcgtcgatagcttcaccggtttcgccggtcactttatccagcttcggttgcgtaacgccaagaccaagcaggaagtgattgacccaacctgccaatgcatcagcccgatcgaaaacgctgacatcatcgccatcaggcagataaagctgaaaaaggaagccgtcatcctgcagggcatcgctggtggcagagtgcattttacgcagtgcctgtgccagctcatgaccgaaagccatgccttcgttcgtcaggtcgtgaagtagcggtagccatgagctgtcatcgttaccgccacatatcatcccgctgattaaaccatgcatctcagctggggtcagacccgtcccttgttggttcagatactggttcatttcgttgtaaccaggcatttcgttctgtatagacataagcattcgtcgtcaaagggaggaatattcatgatatgctaccactttgggccctggtggaccagaaaagggcttgtctcttctcatcagggtagctatagtgtcgccccttcgcagaccatgggtctaaagacgaaggcagcgcagtcaatcagcaggaaggtggcatgtctgcacaacccgtcgatatccaaatttttggccgttcactgcgtgtgaactgcccgcctgaccaaagggatgcgttgaatcaggcagcggacgatctgaaccaacggttgcaagatctgaaagaacgcactagagtcacaaatactgaacagttggtcttcattgccgcattgaatatcagctatgagttagcgcaagaaaaagcaaagactcgtgactacgcggcaagtatggaacagcgtattcggatgctgcagcagaccatagaacaagcgttacttgaacaaggtcgcatcaccgaaaaaactaaccaaaactttgaatgacacttttcggtttactgtggtagagtaaccgtgaagacaaaatttctctgagatgttcgcaagcgggccagtcccctgagccgatatttcataccacaagaatgtggcgctccgcggttggtgagcatgctcggtccgtccgagaagccttaaaactgcgacgacacattcaccttgaaccaagggttcaagggttacagcctgcggcggcatctcggagattcccttcttatctggcaccagccatgacgcaactaccagaactcccactgacattatcccgacaagaaatccgcaaaatgattcggcaacgtcgtcgtgcgttaacgccggaacaacagcaggaaatgggtcaacaagccgctacccggatgatgacttatcccccggtggtgatggcacatacggtcgctgtattcctctcttttgatggcgaactcgacacccagccactcatagaacaactctggcgcgccggtaagcgcgtatatcttccagttttgcatccctttagtgccggtaatttgctgttcctgaattaccatccgcaaagcgaactggtgatgaacaggttgaagatccatgagccaaaattggatgtgcgtgacgtgctacccctttcccgattagacgtgctgatcacaccgctggtcgcctttgatgagtacggtcagcgcctgggaatgggcggtggtttttatgatcggaccttacaaaactggcagcactataaaacgcaaccggtgggttatgcgcatgattgtcagttggtggaaaaactccccgttgaagagtgggatatccctcttcctgcggtggttacaccgtcgaaagtctgggagtggtaagggcgatacacccgcatcgccctgattgacatcgttgattctttgacctaatttagtgagtaagggtaagggaggattgctcctcccctgagactgactgttaataagcgctgaaacttatgagtaacagtacaatcagtatgatgacaagtcgcatcataacccttctccttcaagccctcgcttcggtgagggctttaccgttacagccccatgctgccctgccatcgtaaatccccattaaataaacacaacgcattgatctgactttgatttattttctggagcagactcgcaaagtagaatgcgcaacgcggcaacggtgtggagaagggataaaaaaacgggcaagtcagtgacctgcccgttgattttcagagaaggggaattagtacagcagacgggcgcgaatggtacccggaatagctttcattgcctgcagcgctttttcggcaacgtcttcgtcggcttcaatatcaataaccacataacccatctgggcggaagtttgcagatattgcgcggcgatgttgacgccctgctcggcgaagattttgttcagcgcagttagcacgcccggacggttttcgtggatgtgcatcagacgacgcccaccgtgcagtggcagcgagacttccgggaagttcaccgcagagagcgttgagccattgtcagaatacttgatcaatttacccgcaacttccaggccgatattctcctgcgcttcctgagtcgaaccgccaatgtgtggcgtcagaaggacgttgtcgaattcacacagcggagaggtaaatggatcgctattggtcgccggttccgtcgggaatacgtcgattgccgcccccgccagatgtttgctcgccagcgcatcacacagcgccggaatatccaccacagtaccgcgcgaagcattaatcagcagcgagccgggcttcattagtgaaatttctttcgcgcccatcatatttttggtggacggattctctggtacatgcagactcaccacatcgctcatattcagcaggtcagaaagatgctgtacctgagtggcgttgcccagcggcagtttattttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacggtgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttccgatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatttacccaatcctgtcttttgaaatgttgtgtgcggatttgcatccgcctttcaacatatcaaaaaataatattgcggcaatatgaacgtttgcgtcgcgatgttgaggaaatatcacgcaaaggtaattcttggatgaatatgctggtttagaggatttatttagagcaatcgacaattgcctggtaaaagcgtgacacatgtcaccaaatttaatgaagagaatttttttaacgggggaggttcccccgtcagatcatttcacaatggttttgacaccgtcaggtgtgccaatcagcgcaacgtccgcgccacggttagcaaacaagccaacagtcaccacgccaggaatcgcatttatggcgttttccatcgctatcgggtcaaggatttccatgccgtggacgtcgaggatcacgttgccattatcggtcaccacgccctgacggtattccggacgaccgcccagtttcaccagctgacgcgccactgcactacgtgccatcgggataacttctactggcagcgggaatttacccagaatatcaacctgcttggaagcgtctgcaatacagataaatttttctgcaaccgaagcaatgattttttcacgggtcagcgccgcgccgccgcctttgatcatttgcatgtggccgttgatttcatctgcgccatcaacgtagatgccaaggctgtcgacttcgttgagatcaaaaacgtgaatgccgaggcttttcagtttttcagtggaagcatctgaactggaaacggccccttcaatctggcctttcattgtaccgagcgcgtcaataaagtgtgcggcggtggaacctgtacctacaccaacaatggtgccgggctgaacatactgaagtgccgcccatcctactgcttttttcaattcatcctgcgtcatgatcgtttcgcctgtggtatgaaatttcacacgcattatatacaaaaaaagcgattcagaccccgttggcaagccgcgtggttaactcatccataaaatatcgcgcaatggcaggcatcccctttcgccccgcaaataaagcatacaacggtctgggtatgccgctccacggtgcaaacaggcgcaccagttcaccgttcgcaagcccctgtttacaggcaaattgaggcaataacgccacgccattcaacacaaccagggcgcgaactcgctgagcgaaatgcattagcgcaaatccctgatcttttaagctgcgcttttaaccacggatacaaatgttacccgccgacggcttcggtatatgcaacctgacacaaaattgtgtcatagtgcaggaaaaagcatttaccaggagcagacaacagcaatgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgctgttggtgcgtaccgtaccgccgcgcccgacggaacaagggcaaaaactgctggcactgctgcgccaggtggagttgctggaagaagagtggctgggcgatgaacaaaccggttcgactccgctgctgctttcactggcggtcaacgccgacagtctggcgacgtggttgcttcctgcactggctcctgtgttggctgattcgcctatccgcctcaacttgcaggtagaagatgaaacccgcactcaggaacgtctgcgccgcggcgaagtggtcggcgcggtgagtattcaacatcaggcgctgccgagttgtcttgtcgataaacttggtgcgctcgactatctgttcgtcagctcaaaaccctttgccgaaaaatatttccctaacggcgtaacgcgttcggcattactgaaagcgccagtggtcgcgtttgaccatcttgacgatatgcaccaggcctttttgcagcaaaacttcgatctgcctccaggcagcgtgccctgccatatcgttaattcttcagaagcgttcgtacaacttgctcgccagggcaccacctgctgtatgatcccgcacctgcaaatcgagaaagagctggccagcggtgaactgattgacttaacgcctgggctatttcaacgacggatgctctactggcaccgctttgctcctgaaagccgcatgatgcgtaaagtcactgatgcgttactcgattatggtcacaaagtccttcgtcaggattaatccatcaaataatgcctgatagcacatatcaggcgttgtcctcacttctttttgtattccttgaatcacatcacaaaatagacaaatctcaggcggcaaaaaacgacgtctgaatgcattttttttgctggcgacaaacccacgtaaaaagctcaccgtaggcgcaaataccctcattttgattgcgttttacggagcaaataatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaatgactcgtcccgtcacgatcttcagcaatatgctgaagcatcgtggcggtataacgatgatttctgattgaataaagatattcctgcatatacatcggcctgtgcggtgcatcaaaatatttcagcgttgccggattcaccagtcgccaggcaaaatgcgggatcaccgtcagaaaatgtccgcgctccacggcgctgattttggccataaaactgtagggacgataaataatggttggattgatcccacaaggtcgcatattcgcatcaatcattgcttcgaagttggcccggttctgaaagcgcatttgtagccagggcagctcctgaagcagctcttgctcttgtcgctcttcataacggcgagaaacgagaaagcctaatcgcagcggtggtagttcactgatagtcaggttttccagttcctgaactcgtgcagatacatgctgtggggagataataaaatctaactggcggtcaaaaagattatcgataacgccattttcgctgaactcaactggctgggcggtcacgccttcatacttatctccgagactaatcaactgatcgaaaataattgtcggataagtattatctatgccaatcacaatttctcgtgaacgacgccctgagttatggatttcattatcaatcgcagaaagccgttgataaaccgggaacagtttttgatacagttcctgtccggctttattgaggctgatattattatctttgcgggtaaatagcgtatagccaatttgttcttccagcgcggcaatgcttttaccaaatggcgaagccgtcatatggattttttctgccgcccgggcaatattattggtttgcgctaataaaatgaaattgcgcatctttttcgaaataaaaatgtccatccccctcccccgcatccttgtccgcttaaccgtttcagtcagcctatccttgatgaaaccgcgagcaaagataggtgattacgtcatggttttacagaaaattacagaaaaaggaggcaatatcgggtaaaggcattagcccgacgaatacgtcgggctacaaatattattgtgctgcaggtgttttagcgggttgttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccagttcctgcgcctgatgaatcgcgttatcaatcgctgccttacgcgctttgtctttataggcatccggctgcgccacgcccagcgacacagaacgaatttcgttaagacccgccttcagcgcgccatccagcaaggaattcagtttgtctaactgacggagcgtgacttccaccgttctcacagcgcggtagcctttaaggatacttttaccatcctgataatcataatctggctgggtgcgtaagttcgctgagctgatatcttttttcgcgatctgattgagttcaaggaaggaaatgtattgtgcgacgcgctcatctgcctgtttcttggcagtagcggcatccttcgcggccacgttaacttcaatcgcaagagtggcaatgtctggcaccgcatccacgcttgccgtaccggaggtgacaatatgcggtccatccggcaattcgttagcctgcgctgccatcccgctaatacccattaatgccgccagggcgataactttgaacttcacgttagtctctccgtgttaattgacttgcccaaaattcaggacctctggaggcaagcttagcgcctctgttttatttttccatcagatagcgcctaactgaacaaggcttgtgcatgagcaataccgtctctcgccagctgcaaggcaataaaccacataacacatcccacaaccagattgataatgcgctgtgcttttgccgtgcgcagacgcggtgccagccaggctgcgagaagagccagaccaaagaaccacaggaaagaggcgctaattgtcccgagtgcaaaccagcgttttggttccacatcaagttgcccgccaaggctgcccagtacaacaaaagtatccaggtaaacatgcggattcagccaggtcactgccaacatggtggcgataattttccatctgccttgcttcatgacttcggcgctggctaactcaatattactgctcattgctgttttaaaagcgccaaaaccataccacagcaagaaggctacgccgccccaggtgaccagcgccagcaaccacggcgactgcatcaataacgcgctgccaccaaaaatcccggcgcaaatcaggaccaaatcgctgatagcacaaagtaaggcaatcataatgtggtactgacgacgtatgccctgattcatcacaaaagcattttgtggaccgagcggtaggatcatagccgccccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcaccaagttcgttcaggcgcacagtcatttcgcgatctttcaaaatgcgatcttcagactggataatattggtcaggatctgcttaacctgatcgatatcggaatcatacgccacgccaataataaattcgttacggcgaactggctcgcgggagaagttaataatatttccggcaataattttaccgttcggaataacgataattttaccgtctgcagtacgcatggtggtggagaaaatctgcacactcagcacagtaccggctacgccgcccaggtcaacatattctccggcacggaacgggcggaacatgacaagtaacacgccagcggccaggttagacagtgacccctgcaaagccagaccaacagctaagcctgcggcaccgagtacagcaatgactgacgcggtttgtacacccacgcgtcccagtgcagcgattagcgtaaaggcgataataccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagctaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgaatcaccttgcttttggcgaaaaaatccccgcagagcggggctcagacagatatcaatgtgcgctttgtcatgccggatgcggcgtgaacgccttatccggcctacaaaaacctgcaaattcaatatattgcaggatacgtgtaggcctgataagcgtagcgcatcaggcaattttgcttttggcgaaaaaaagacccgcagagcgggccttgagataagcagaaaggaatatcttacagaacgtcgatcgcgttcagttcctggaatgctttctccagacgagcgatcatcgaagtctgaccggcacgcagccatacgcgcggatcgtagtatttcttgttcggctgatcttcgcctttcgggttacccagctgaccctgcagataagcttcgttcgctttgtagtagttcagaacgccttcccaggttgcccattgggtatcggtatcgatgttcatttttactacgccgtagcttacggagtctttgatttcctgagcagtagaaccggaaccaccgtggaatacgaagttcaggctgttgtgcggcaggttgtgtttcttggaaacatattcctgagaatcacgcaggatggtcggagtcagaaccacgttacccggcttgtaaacaccgtgtacgttaccgaaggacgctgcgatggtgaaacgcgggctgattttgctcagttcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcgatgttctcttgcagagattcttcagacaggtcgatcatgtgagaagagaacagcggcttaccggtagctgcgaagtgtttttcacccgcgtccaacagaccgtcgatccacggcagcagtttcttcgcgcagtggtcagtgtgcaggataaccggaacaccataatgttcagccatctggtgaacgtgatgcgcaccagagatcgcgcccaggatagcagcaccctgcggaacgtcagatttcacgcctttaccagcgataaaggaagcaccaccgttggagaactgaacgataaccggcgctttaactttagcagcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctgcgttcgctcaccccagtcacttacttatgtaagctcctggggattcactctcttgtcgccttcctgcaactcgaattatttagagtatgaaaaattgcgtgctctaaaagcgcgctgaaacaagggcaggtttccctgccctgtgattttttacttcttagcgcgctcttcgagcatcgctactgcaggcagtactttaccttccacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtggtcagcagacgtttagcttcgtcaaccaggtcagcttcgtacagggatttacccacatcgtggccttgtgccgcgataaaggtgttagcgataccaccaccaacaatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagggtttcgtcgtctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggccagttcgatggtcggcagagaagcacggatacgcgcgtcgctggttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgggtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcttcaaagcgatcgttaaattgcggaaaaaatcgtgtgataccggcggccagtttagtatcgaccggaatgatcgactggctggctgcccgggtgcgacgcaggtcaggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccgtaaacaacggtcgcgtcgagatcgttactgccaggatgtgaaaagagcacttttttggccccggcggcaatatgcgcttcgccatgctcgcgggagccatatacgccggtgcagtcgaggactacatcaacgccaagttcacgccaggggagcgattgcagtgaacgttcatgcaatacgcggatggcgtcatcaccaacaaaaagttgatcgcgttcctgtcgtacttcccatgcaaaacggccatggctggtgtcatatttcaacaaatgcgccatgcccgcagcatccgccagttcgttgattgccaccacggtaatttccgcccggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgtccggggaaaccttacctgtcgcaaactgcgactgattggttaattgtcgaacatttaatcgactgaaacgcttcagctaggataagcgaaacgtggaataaaaggaatgtttgtccagccgaagaagacatttatctgactcacatcacacttttatccccttttgtgggaagctttattccaggctggcgtaataataaccctacaataactggaataaattgtcagcttgtgaagtgataccggccttcttcagtcatctctactatcagattggcctgacggctattcatcagcacacgctcgacattggggccatcggtgcgggcataaaatgcttcggctacttgccgcgttaatcctcccgcaattttacgactaatcaagcgctcccgcagaatttgagcaggtgcatgaataaaaatagaaaaatcgcagaaagatgccaactccagccacttttcatcatccagtaacaaccagtttccttcgacgatgacgagtggtgcggtaacgtgcaacgcatcttcaacaggatcatgcttttgtcgatcgtactgcggccacgtacaatccccttccacgacctggcgcagattttccgtcagtttcgcaacgtcaaatgtctctggtgcgcctttgaaggggcgcaattgatgcgcatccagccagctattgtaatggtgaaaaccatccatcgggagcgtctgaatagcgggcagttccgggtcttgttgcgcgagatattcccagaaggtggttagggttgatttacccgtccccggcggagcgcaaagaaaaaccaccgtacgccgctgcggatttaccgtctgtaaggccgccaacatgtgcagcaacggtttatgtacattttcaatctcttcgttctggtactgtgcctgtatcttcagcccattcaccgttaattcaattttcacggcgttaattcctttaaggtggtcgttactgccagcgtcagcgccgttttgaccattccgctaaaacgcgcctctgaccagacggagaaatcagcgaacttcatcgcttttaacgcgtcatagagcatcgcattgcgggttatgctattgacgttgctgataaaatcccaggtcatgtcatcggcaaatccgggcgtttcatcctgttcgttcaggtaatgccagaactgggaaaaatgcgtgatatcggcgtacaaccatttatccattttccccaacgcataaatcaaacgcagtgcaacatcaatatcgtcaagcgggccgctttgggcgagtaacggcttcactgcatattccacgatctcttcatcgttatcgacaaacagcgacggcagaaactggcgtatcccctggagcaaaatggtatgcgcagttttcataaatgaaaataaattgtcctgtgcatccagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccagctcaccgcccgtcacgcccgtagcgctaaagaggatatcgttccccctcaccagttcatcgagcgagtacacacggttaacgtcaacgcccattgccttgcaacgcttgcgctcctgctctgcaatctgccgattttccgtgtaatcccctttagcctggcaaaagtcaatcagctcggcctgcatatccccgcctaatgctttaacggcacaggcagaaatcacgccttctggcgcaccgccgatggtgtacatcacatcgtaaggattatcctgccagcaggtcagcacgctggcggcgacatcgccatccggcagggcaaaaaccttcacgcccagctgtgttgcttcctcaatcgcggcactcaggcgcggtttatccagcgtaaccatgcgcagcttatccagcggtttgcctaacgctttcgccacgttgcgcaggttgtccgtcagaggcaaagacagatcaatcgcgcccgccgccagccgattaacaaccagctttttcatatacatatcgggcgcatgtaacaggctatctcgaggggcgaaagccatgaccgccagcgcattgctctgccccatcgccaccatccgcgtgccttcaatgggatcaaccgcgatatcgacttctggcccatcgcctttgcccacctcttcgccaatccacagcatcggcgcatggtcaatttctccttcgccgataaccactcgtccacgaaaagcgacgtcgtttaatgcctggcgcatcgcggtgaccgccaggccatcaattttatttttgtcgccacatccggtttgcggccaggcagccaacgctgcctgttccgtaacgcgaaataatggccacgccagggacatcattgcgcggcctccccgatatcaacgccaaattgtgccagcagatatttctcggcctgttcattccagatgccgtgcgtttcctcaaccagccgcgccaactctttaaacagcggatcggttttgcctttttcggcaaaatcggcaatggcagtgagcggcatggtcacgccgttataaatgagttttttaccgccagggatatccggcagattgagcacggtttctggcaccgcatccaggccaccgatatgggtcaccataaacgacggctgtaactgcccagtggcgctaagggcaatcgcctctttcatgtcgtccgttgaaccgccagatgtaccgacgacgtgcgtgctgttgtaatggacgttgtagaaattaaacggcactttgaagtttttatccgtcggcccggcaaagaagttcagacagccatcttccgccagtaattcatcagccatctcaacgacagcaggcaccgccgcataaacaaaaatgtcatcgaacccggcatctcctgtcagcgcccgcagcatctggacaggatcgctcatccctttggtattcacatacaccagctcaatgcctttactggccgccagttccaccggcagcagcttctgtacctgcgccagacgtttgtcgtcgatatcgaccaccaccacccgcgacggttgtatgccgccgttaatggcgtaatcgatagcgccaatgcccatcggacctgcacacgccagcagtgcaatattgccgccaggtttgacgcccatgcgatgctcataaacatattgcgtggtgtgataattggcatgataagcaccaataatgcagcacataggctctgccagcgacgccgcagcaaaataagagccgtgatacggtaatacgcagcccaaattaatggcgatttcgggaataatcatataagtggcattgccgccaaaatattcgtagctgtagcccgctgaatatccgcttggtaaccccatcgccggttgcaatacaaaacgctggccttttttatatttgccagtgagatttttacccacttcgacaataaccccggcacattcatgcccggtaatgaccggatgattttctaaatcgtcgggtacgcgtttatgttcactaccgagtaacgccgctttccaggtcgataaacagacgctgtcagaaattacactcaccagtaattcattatcggtaatttctggcagttcaaatacgcgcagacggacatcccgcttgccataaatagcagcaactttggttttcatttttacctctgtaatcagtgtttatgttcggcggttaattgattaaataaagtgtcgagttttggatcgccaatatagttattaatcaatatcagtggtttatccgtcacacgtttcacgcgcccttccagactggcatgagtaacgacgatatccgcatccgcaggcacgttttctatggcgtaatgttttacttcaattgccagccccgctttttccaggcgtttacggaaggtggtcgcgcccatcgcactggagcccatccccgcatcgcaaacaaaggcgatacgcttaaccctgcttaacgagaatgcaccctcttgtttcatcgccttaaccgcattggctgactgagcaaactcatcttcgctctccgtttccaccgttttttccatcttcagtatcagcgaagtaatagcaaaggacaccagggtacctaccgtaacaccggcaattgtcgccaggaacgagcctttcggcgtcagtgccaggtaagcaaagatagaccccggacttgggccagccaccagaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccaggcccggacctgggttagaggccaccataaagaagatggatttaccgttaaccgaagcctgttgcattcccagcggataatagacgccctgatcgatcgcattattgaggaaaagcactttcgccggttcattgatgactgacaacaatggcagataacccgcatgtaccagcgcctcaatacactctttgacgaaagtattggcaattaacaccgccgggccgataacttcaaaacccagcagacaaaggagcatccccgcgatacctaatgagaagttattgataaccatctcaaaaccggcaggtatgcgtttttccagtgccttatcgacatattttatgaccaacccaccgagcggccccatgatcattgagccaaggaacatcgggatctctgcgccaacgatcacaccaatagtacctattccgcccatgaccgccccgcgtttaccgccgaccagatgaccacctgtagaaccaatcatcacgggcaataaataggtaatcatcgggccgacaattttggcgaaatgttcgttaggcagccaaccggtgggaataaataacgcagtaataaaaccccaggcaataaaagcaccaatattggggatgaccattgcagtcaaaaagcccccaaaagcctggacctttgcacgagcagacttgttttccataatattatcctgtagaggagagagtaattatccgcggctgataatgtccgctaattgtttttctgatgatgctgttaagagttgttcgagtatttcttcttcgcacagtaattcacttaacgcctgaatagcgccaatgtgcgaatcggcatcggcagcagagagtccgatgagtaatttaattggttcgtcattccccggaaaataaacaccttgttcaagtaatgtcaaagacatcccggttttaagcgccccacattccggtcgcgcatgaggcattgccacgcctggtgcgagaatataataagggccattgttaatggtggaatctttaattgcctgaatgtaattctcgctgatatagtttttatccagcaatgataccatcgagaaatcgatagcttcctgccaatcttttgctgaatgtataactgagattgatgattctggaaaataatcactaagccgcataaattatccttattttatttttagggtaccgtccggcggtaaaaataaaatactcgtgcggtttaatgaaagcaattgagcagggaaaccggtgttttgaaaacagtgaattattaatttcttatataacattgagttatagatataacaacaaatgtcaatacgcatatcgtgatgcatattacataattgatatttattgcatataaatatttgtgatctacaacacgccttatctattgcttgtccgcaaacggacatatcaaggtaataaaaaaggtcgccgaagcgacctttttacccgaaatgctaattacagcagttcttttgctttcgcaacaacgttatcaacagtgaagccgaactcttcaaacagcagctctgccggagcagattcaccgaaggtggtcataccgacgatagcaccgttcaggccaacatacttgtaccagtagtcagcaatacccgcttctacagcaacgcgtgcagtaaccgctttcggcagtacggattcacggtaagcagcatcctgcttgtcaaatgcgtcggtagacggcatggacaccacgcgcgctttcacgccttcggcagtcagtttttcgtaggcagcaacagccagttcaacttctgaaccggtagcgatgaaaatcagttccggctgaccggcgcagtctttcagcacataaccaccgcgcgcgatgtttgccagttgctcttcagttcgttcctgctgcgccaggttctgacgggagaggatcagtgcggtcgggccgtcctgacgctcaacaccgtatttccacgcgaccgcggattcaacctggtcacacggacgccatgtagacatgttcggggttacgcgcagagaagcgacctgctcaaccggctggtgagtcgggccgtcttcgcccagaccgatggagtcgtgggtgtaaaccatcacctgacgctgtttcatcagcgcagccatacgtacggcgttacgtgcgtattccacgaacatcaggaaggtggaggtgtacggcaggaagccaccgtgcagggagataccgttagcaatcgcggtcataccgaactcgcgaacaccgtagtggatgtagttacccgcagcatcttcgttgattgctttagaaccagaccacagggtcaggttagacggcgccaggtcagcagaaccgccgaggaattccggcaacagcggaccgaacgcttcgatagcattctgagacgctttacggctggcgattttcgccggattagcctgcagtttagcgatgaactctttcgctttagcgtcgaagtcagacggcatttcgcctttcatacggcgggtaaattcagcggcttcctgcggataagctttcgcgtaagcagcgaatttctcgttccatgcggattctttcgcctggcctgcttctttcgcatcccactgagcatagatttcagacgggatttcgaacggcgcatatttccagcccagttgttcgcgggtcagggcaatttcagcgtcgcccagcggcgcaccgtgggagtcgtgggtaccggctttgttcggggaaccgaaaccgatgatggttttgcacatcagcagggaaggtttgtcagtcactgcgcgcgcttcttctactgcgcgtttgatagatgccgcgtcatgaccgtcgatgtcgcgaataacgtgccagccgtaagcttcgaaacgcattgcggtgtcgtcggtgaaccagccttcaacgtgaccatcgatagaaataccgttgtcatcgtagaatgcaatcagtttacccagcttcagcgtacccgccagagagcaaacttcgtgggagatgccttccatcatgcagccgtcgcccatgaaggcgtaggtgtagtggtcgacaatgtcgtggcccggacggttaaactgcgccgccagcgttttttctgcaatcgccataccgactgcgttggcaataccctgacccagcggaccggtggtggtttccacaccagcggtgtaacccacttccgggtgacccggagttttagagtgcagctgacggaagtttttcagttcttccatcggcagatcgtaaccggtgaggtgcagcaggctgtagatcagcatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgcgcgtcatgtacatggaacatccttttgccgcttcagaaatctctggatcatgctcgcatgttgcgcaatctactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggcaacggtactgactggttgccagaatatggactccaacggactgctctcatcaggagcggaagcttttcaggcttacagtttgagtgatgcgcaggtgaaaaccctgagcgatcaggcatgtcaggagatggacagcaaggcgacgattgcgccagccaatagcgaatacgctaaacgtctgacaactattgccaatgcgctaggcaacaatatcaacggtcagccggtaaattacaaagtgtatatggcgaaggatgtgaacgcctttgcaatggctaacggctgtatccgcgtctatagcgggctgatggatatgatgacggataacgaagtcgaagcggtgatcggtcacgaaatggggcacgtggcgttaggccatgtgaaaaaaggaatgcaggtggcacttggtacaaatgccgtgcgagtagctgcggcctctgcgggcgggattgtcggaagtttatctcaatcacaacttggtaatctgggcgagaaattagtcaattcgcaattctcccagcgccaggaagcagaagccgatgattattcttacgatcttctgcgccaacgcggcatcagcccggcaggtcttgccaccagctttgaaaaactggcaaaactggaagaaggtcgccaaagctcaatgtttgacgaccatcctgcatccgccgaacgcgcccagcatattcgcgatcgcatgagcgcggatgggattaagtaaagcctggtggtgtcgaacgtaggtcagataaggcgttcacgccgcatctgacatgaatggcacatttgttaccttgtgcgcattgccggatgcgatgctggcgcatcttatccggcctacgggtgccgaacgtaggtcggataaggcgttcacgccgcatccgacattaatggcacgttttacccgtgcgcatcgcatctggtgcttactcgccctttttcgccgcctgaatatacagcatttccagcgccagcgttgccgctgccagagcagtgatttccgactgatcgtatgccggagccacttccactacgtccatcccaacaatgttgagatctttcaggccgcgtaccagtttaatagcgcgatcggaggtcaggccgccaatcactggcgtaccggtgcctggtgcaaaagcaggatccaggcagtcgatatcaaaagtcaggtaaaccggcatatcacccacaatctgtttcacttgggcgataacgtcatccacgctgcgatcgttcacctggcaggcgtccagcacggtaaagccgttgtctttatcaaactcggtacgaataccaatctgcacggaatgattcgggtcgatcagaccttctttcggcgcggtatagaacatagtgccgtggtcaaattcacaaccgttcgcataggtatcggtgtgggcgtcaaagtgtaccagcgccattttgccgaaatgcttcgcatgagcacgcagcagcggcagcgtaacaaagtggtcaccaccgaaagagagcatacgcttaccggcagccagcagcttctcggcgtgcgcctgcagcttttcgctcatctcacgggcatcgccaaaggcatataccagatcgccgcagtccacgacgttcagacgctcacgcatgtcgaaattccacgggaagcggttgtgttcccaggccagattcgtcgaaacctgacggatcgctgccggaccgtggcgaccacccgcacgaccagaagtggccatatcgaacggcacgccagtaatcacccagtctgcatcgctgtcatacggctggaagttcatcggcaggcgtaaaaaaccaaaggcattggaaaccagtgagttatcgtattgatgacctaaggtgctcatggatggactcctattacaaagtcgatataaaaaaacccttccgcgtcgttaggcccgacgaggaagggttggatttgtcacaataaattgtggcggattatcaccgctaaattaagcggattcaagtaacacaggacttactcatcttcaagataagtataaccgtacaaacctgcctcgaactcttcaaggaactgttgttgcagttcagcatcaagatcggttttcttcacttgatcgcggaactgggttaacagcgttttcggatcgagctgtacatattgcagcatgtccgccacggtatcgccttcgtcagacagttctacttctacgctaccgtcagggaagacgaacacgtcaaccgcttcggtatcaccgaacaggttgtgcatgttgccgaggatctcctgatatgcgccgaccataaagaaaccgagcatcggcggattctctggatcgtactccggcattggcattgtcgtggcaataccgtcaccatcaatatagtggtcgatagcaccgtcagagtcacaggtaatatccagcagcacagcgcgacgttccggcacttgatccagcccttccagcggcagaaccgggaacaactggtcgatcccccatgcgtccggcatcgactggaacagcgagaagttgacgtacattttgtccgccatacgttcctgcagctcgtcgataatcggacgatgagcacggttttgcggatccagctgcttttgcacttcatggcacatgctcaaataaagctgctcagcccatgcacgttcttgcaggctaaagatgccggaagagtagccgatatgaatgtcgtgcagatccatctgactgtcgtgtaaccattcacgcagagaacggcgagttcccggttcgtgcatctcctgccaggtttcccacatgctttgcagcgcgcgcggcgcatcttctgcaggcgcggtcggcaccgtgtattcgttacgttccacgccgatgatattagacaccagcacggtgtgatgcgcagtcaccgcacgacccgattcggtgattaccgtcggatgcggcagaccgttttcttcacacgcatcgccaatcgcccagataatgttgttggcgtattcattgaggccgtagttcaccgaacagtcggactgcgaacgagtaccttcataatccacgcccagaccgccgccgacgtcgaagcactgaatattgacgcccagcttgtgcagttccacatagaaacgcgcggattcacgaacgcctgtcgcgatatcgcgaatattcgccatctgcgaaccgaggtggaagtgcagtagttgcaggctgtcgagacgcccggcttcacgcagggtttcaaccagttgcagtacctgagtcgcagccaggccgaacttcgatttttccccgccggaggactgccatttacccgaaccctgcgaagccagacgtgcacgcacgcccagacgaggaacgacattcagacgttctgcttcatccagcacaatggcgatttctgacatcttctcaatgaccagatagaccttgtgccccatcttctcgccaattaatgccaggcggatatattcgcggtctttataaccgttgcagacgatgacgctacgggtcatgccagcatgtgccagtactgccatcaactcggctttggaaccggcttccagacccagcggttcgcccgaatgaatcagggactcaatcacgcggcggtgctggttaactttgatcggataaacaaggaagtaatcgccgttatagccgtaggattccctcgcacgtttgaacgcggcgttaatggaacgcaaacggtgctgcaggatctgtgggaaacagaacagtgcaggcagacgctggccctgtgcttcacgagttttcactaactgcgcgagatcgacgcgagcttccgggacgtccgggtccgggcacacgctaatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgaatgctgacgctccaactgcgcaaccggtttctttttcataacattattaagcacataaccgaacgtaagtgtgaaagttcggcgaaaccacgagaaaactcttgtttttacaagagcgcccttgttcagtcctcagtaactgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgatttcaacccggctggaagtggcaacacgaaagaaacgtcgtgtgctttttatttaagccgcgcgccgcgttttataccccacaatggcagaaaattgcaaaagataaatacgcagaatgccggcattgtcaggaaaaatttccagccacgtttttaacagaatgagacacgattcaaaaaaaagtggaaatagggtgaagaattgacctaaaatagccatccagatgttaatccatccataccgattaacactcagactgccagtgtttttaacctgcagagtcgtggtaggatccgctaccacagaaaatccacacaacagtttgagctaaccaaattctctttaggtgatattaaatatggcaaaacacctttttacgtccgagtccgtctctgaagggcatcctgacaaaattgctgaccaaatttctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaacaccgttcgcgaaattggctatgtgcattccgacatgggctttgacgctaactcctgtgcggttctgagcgctatcggcaaacagtctcctgacatcaaccagggcgttgaccgtgccgatccgctggaacagggcgcgggtgaccagggtctgatgtttggctacgcaactaatgaaaccgacgtgctgatgccagcacctatcacctatgcacaccgtctggtacagcgtcaggctgaagtgcgtaaaaacggcactctgccgtggctgcgcccggacgcgaaaagccaggtgacttttcagtatgacgacggcaaaatcgttggtatcgatgctgtcgtgctttccactcagcactctgaagagatcgaccagaaatcgctgcaagaagcggtaatggaagagatcatcaagccaattctgcccgctgaatggctgacttctgccaccaaattcttcatcaacccgaccggtcgtttcgttatcggtggcccaatgggtgactgcggtctgactggtcgtaaaattatcgttgatacctacggcggcatggcgcgtcacggtggcggtgcattctctggtaaagatccatcaaaagtggaccgttccgcagcctacgcagcacgttatgtcgcgaaaaacatcgttgctgctggcctggccgatcgttgtgaaattcaggtttcctacgcaatcggcgtggctgaaccgacctccatcatggtagaaactttcggtactgagaaagtgccttctgaacaactgaccctgctggtacgtgagttcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgcgatgctgccggtctgaagtaatctttcttcacctgcgttcaaaggccagcctcgcgctggcctttttcttttggataggcgttcacgccgcatccggcaaaaaaaccgcccgcacaataacatcattcttcctgatcacgtttcaccgcagattatcatcacaactgaaaccgattacaccaaccacaacagacaaagatttgtaatattttcatattattattcggttttcacagttgttacatttcttttcagtaaagtcttaattgcagataacagcgtttaatctatgatgatataactcaattattttcatgcacttaaatcataactaagataaatgttagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaattttgtttgttgccggttcgctgttctctgcggctgcgccaaacgttgaagtactgattctttcccgcgttctactggggctggcggtgggtgtggcctcttataccgcaccgctgtacctctctgaaattgcgccggaaaaaattcgtggcagtatgatctcgatgtatcagttgatgatcactatcgggatcctcggtgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactgttgcaggtaatgcagcaattcaccgggatgaacgtcatcatgtattacgcgccgaaaatcttcgaactggcgggttataccaacactaccgagcaaatgtgggggaccgtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtattcactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaataggcgctcacgattaatctccccaagcttcctcccatcgcggaggaagccacctcttgcagtcatcttttcttcgctctatcctctgccgctatgaaaacatcccgtctccctatcgccatccaacaggccgttatgcgtcgcctgcgggaaaaactcgcccaggccaacctgaagctagggcgtaactacccggagccaaaactctcttacacccagcgcggaacctccgccggaacggcctggctggaaagctatgaaattcgcctcaatcccgttttgctgttggaaaacagtgaagcttttattgaagaagtggtaccgcacgaactggcacatttgctggtatggaaacatttcggccgcgtagcgccacatggcaaagagtggaagtggatgatggaaaacgtgctgggtgttcccgcccgtcgtacgcatcagttcgaactgcaatccgtgcgtcgcaacaccttcccctaccgctgcaagtgccaggagcatcagcttaccgtacgccgccataatcgcgtagttcgtggcgaggccgtctatcgctgtgttcactgcggtgaacagctggttgcgaaataaccatctgaactatcaggaactttcctgatctggctgattgcataccaaaacagctttcgctacgttgctggctcgttttaacacggagtaagtgatgtaccgttatttgtctattgctgcggtggtactgagcgcagcattttccggcccggcgttggccgaaggtatcaatagtttttctcaggcgaaagccgcggcggtaaaagtccacgctgacgcgcccggtacgttttattgcggatgtaaaattaactggcagggcaaaaaaggcgttgttgatctgcaatcgtgcggctatcaggtgcgcaaaaatgaaaaccgcgccagccgcgtagagtgggaacatgtcgttcccgcctggcagttcggtcaccagcgccagtgctggcaggacggtggacgtaaaaactgcgctaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagctgccgaaccaccagcgcgtgcacgcggtgccattgcgcgcacctacttctatatgcgcgaccaatacaacctgacactctctcgccagcaaacgcagctgttcaacgcatggaacaagatgtatccggttaccgactgggagtgcgagcgcgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgcatggggccggggcaggcgttgcaattgtttgacggtagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagcttcagcagtggcagaagattgcaattgctgcctgtgagcagtgtggtcgtaaccgggtgccggaaatccgtccagcgatggatctggaagcctggtgtgcagagcaggatgaaggactgaaactgaatcttcacccgcgcgccagtaacagcatcaatacgttgccgttaccggttgaacgcgtccgcctgctgattggcccggaaggcggtttatcggcagatgaaattgccatgactgcccgctatcaatttactgatatcctgttgggacctcgcgttttgcgtacagagacaactgcgctcaccgccattaccgcgctacaagtacgatttggcgatttgggctaacggagaagaataatgatcaagctcggcatcgtgatggaccccatcgcaaacatcaacatcaagaaagattccagttttgctatgttgctggaagcacagcgtcgtggttacgaacttcactatatggagatgggcgatctgtatctgatcaatggtgaagcccgcgcccatacccgcacgctgaacgtgaagcagaactacgaagagtggttttcgttcgtcggtgaacaggatctgccgctggccgatctcgatgtgatcctgatgcgtaaagacccgccgtttgataccgagtttatctacgcgacctatattctggaacgtgccgaagagaaagggacgctgatcgttaacaagccgcagagcctgcgcgactgtaacgagaaactgtttaccgcctggttctctgacttaacgccagaaacgctggttacgcgcaataaagcgcagctaaaagcgttctgggagaaacacagcgacatcattcttaagccgctggacggtatgggcggcgcgtcgattttccgcgtgaaagaaggcgatccaaacctcggcgtgattgccgaaaccctgactgagcatggcactcgctactgcatggcgcaaaattacctgccagccattaaagatggcgacaaacgcgtgctggtggtggatggcgagccggtaccgtactgcctggcgcgtattccgcaggggggcgaaacccgtggcaatctggctgccggtggtcgcggtgaacctcgtccgctgacggaaagtgactggaaaatcgcccgtcagatcgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacggtaatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcacaggacggtacgccggactggaacattatcgagcgtttactgaaagagtggcagccggacgaaatcatcgtcggtttgccgctgaatatggacggcaccgagcaaccattgactgccagagcgcgtaaatttgccaaccgtattcatggccgtttcggtgttgaagtaaagctccatgacgagcgtcttagcactgtggaagcccgttccggtctgtttgaacagggcggctatcgggcgctcaacaaaggcaaagttgactctgcctctgcggttattattctcgaaagctatttcgagcagggatattaaggcgatttaaacgcctggcggagtgtaaataatatcatcgcgtcttattgccggatgcggcgtgaacaccttatccagcacacatctggcagcggctataggtctgataagacgcgttagcgtcgcatcagacatttattgcctttgtaggcccgataagcttgcgcatcgggcatggcaacgtcacaaacgcccttcccccacccggtgctgataactctgctgaaacgttatcatccccacctgctgcccggtttgaataacatgcggtaactggtgggttttcccttcgcgaatcaaattccccaccgcgggtgtgttaatcagcaattcaaatagcgccacgcgtccttcctgtttatccacttccagcttttgtgacagcactgcccgtaaactacctgccagttgattacgcacggggtctttttcctgcgccggaaatgaatccaccagtcgctcaactgcctgcgcggcaccacgcgtatgtaatgttgccagcaccaaatgcccggtttctgccgccgtcagtgccagacggattgtctcgctgtcacgcagctctccgagcaaaatcacatcaggatcttcccgcaatgcggcccgcaatcccgatgcgaacgtcatacagtgcaaaccaatttcccgctgctggatcaaacatcgctggctggcatagagatattcaacaggatcttccagcgtcagaatatgcgcatcggcatgttgattgagatagccaaccatcgccgccagcgtggtagatttgccactccccgtcgcccccgtcaccagaatcaggccattctcgctcttgagtaattccggcaataccgttggtgcgccaagctgttcgagctgcgggcagtgcgaaggtaacagccgtaacgccagcgaaatgccatgccgttgcgcgaatgcgctgccacgcaatcgctggttttccgccagcgacacggcaaaatccagctgaccattctccagcaatattgcccgctgatcgtcatccagccactcccgcagtagctcttcgacgtccggcgtatcaaacggcgcagcttccattctgccgcgaatgcgccatcgtgcgggccaggcgctgcacaggtgtagatccgagacgttatgctttacactaagggccacaatttcttccatattcatactaagatcctcggaa
